United States Patent 10,888,096 (BIOPESTICIDES FOR POTATO LATE BLIGHT DISEASE) - sequence listing, part 2

SEQ ID NO: 3 - DNA, 6837781 bp, Pseudomonas chlororaphis 189 (residues 1,709,447-3,418,892 of 6,837,781)
atggcgcgctacaccagcggcaagaccaaggcgttcttctacatcgcggtgatgctgccgatgtgggccagctacatcgtcaaggcctacgcctggaccctgctgctggccaagggcggcgtggcccagtggttcgtccagcacctggggctggagccgctgctgcagctcatcctggggatccccggggtcggcggcagtaccctgtcgacctcgcacctggggcgcttcatggtgttcgtctacatctggctgccgttcatgatcctgccgatccaggcctccctggaacgcctgccgccgtccttgctgcaagcctccgccgacctcggcgccaagccgcgccagaccttcatgcaggtgatcctgccgctgtcggtgccgggcatcgccgccggctcgatcttcaccttctccctgaccctgggcgacttcatcgtgccgcagctggtgggcccgcccggctacttcgtcggcagcatggtctacgcccagcaaggggcgatcggcaacatgccgatggccgccgccttcaccctggtgccgatcgtgctgatcgccatttacctgtccatcgtcaaacgcctgggggccttcgatgcgctctgactcagccaagcatggagaaccagcctcgctgggcctgcgccttgccgcgtggggcgggctgctgttcctgcatttcccgatcctgatcatcttcctctacgccttcaataccgaagacgcagccttcagctttccgccccagggcttcaccctgaaatggttcagcgtggccttcgcccgccccgatgtgctggaggccatcaagctgtcgttgcagatcgccgccatcgccaccctgatcgccatggtcctcggcaccctggcctcggcggcgctgtaccggcgggacttcttcggcaaacaggggatttcgctgatgctgatcctgcccatcgccctgccggggatcatcaccggcatcgccctgctggcgaccttcaagacattggggatcgagccggggatgttcaccatcatcgtcggccacgcgaccttctgcgtggtgattgtctacaacaacgtgatcgcccgcctgcgccgcacctcccacagcctgatcgaagcctcgatggacctgggcgccgacggctggcagacgttccgctacatcatcctgccaaacctcggctcggcgttgctggccggcggcatgctggcgttcgccctgtcgttcgacgaaatcatcgtcaccaccttcaccgccggccatgaacgcaccctgccgctgtggctgctcaaccagctcagccggccgcgggacgtaccggtgaccaacgtcgtcgccatgctggtgatgctggtgaccatgctgccgatcctcggcgcctattacctgacccgcggcggcgaaagcgtggcgggcagcggcggcaaataaccctgtagccgctgccgcagggtcgtggcgccctccggttcgctgaaggccttcggccttatcgcagcctgcggcagcggctacagatcgcagaacatccaacagatatttcaggagaacagccatgcaaaccaagctcttgatcaacggccaactggtcaccggcgaaggccctgcccaggcggtattcaaccccgcgctgggcaaggtgctggtggaaatcaacgaggccagcgaagcccaggtcgatgccgcggtgcgcgccgccgacagcgctttcgaaagctggtcgcaaaccgtgccgaaagaacgctcgctgctgttgctcaagctggccgacagcatcgaagcccacggcgaggaactggcccggctagagtcggacaactgcggcaagccgctgagcgcggccttgaacgacgagatcccggcgattgccgacgtgttccgcttcttcgccggcgccagccgctgcctcagcggttcggccggcggcgaatacctgccgggccacacctcgatgatccgtcgcgacccggtgggggtaatcgcttccatcgcgccgtggaactacccgctgatgatggtcgcctggaaaatcgccccggccctggccgccggcaacaccgtggtgctcaagccctcggagcagaccccgctgaccgccctgcgcctggccgaactggcggcggcgatctttcccgccggcgtgctgaacctggttttcggccgcggcgccacggtgggccagccgctggtgactcatccgaaggtgcgcatggtgtcgctcaccggctccatcgccaccggctcgaacatcatttccagcaccgccgacagcgtcaaacgcctgcacatggaactgggcggcaaggcaccggtgatcatcttcgacgacgccgacatcgacgccgccgtggaaggcatccgcaccttcggcttctacaacgccggccaggactgcaccgccgcctgccgcatttatgcccaggagggcatctacgaacgcttcgtcgagaagctcggcgcggcggtcgccagcatcaagtacggcctgcagggcgacccggacaccgaactgggcccgctgatcagcgcccagcaccgcgaccgcgtggccgggttcgtcgagcgcgccatcgcccagccgcatatccgcctggtcaccggcggcaaggcggtggacggcaacggcttcttcttcgaaccgacggtgctggccgacgcccagcaggacgacgaaatcgtccgccgcgaagtgttcgggccagtggtctcggtcacccgctttaccgacgaggcccaggtcctgggctgggccaacgactcggactacggcctggcgtcctcggtgtggaccgccgatgtcggccgcgcccatcgcctctcggcgcgcctgcaatatggctgcacctgggtcaacacccacttcatgctggtcagcgaaatgccccacggcgggcagaaactctccggctacggcaaggacatgtccatgtatgggctggaggactacaccgtcgtgcgccatgtgatgttcaagcactgaccccgggcagcacgccctgctagaaacagttgccatcggtttcctggcaaaactcgtagggcgtgttgctgatgaaccagtcgagccaatggtgttgccaatccggccactgaatgatgtaggtcttggtggccttgatgaactccaggccaaagatgctgatgctgttgtcgtcctcatacatccgcaggtccagcgtccagtcccggatcaagggcgtgcggtagacccgatccgggtcctcaaggtcgatgatctgcagatagcccttgccgccgaaaggcaccagcaaccccccggccgaggcatgctgcaacaggtaacgaccggaggggctggtcgtcgaatagggctcgcgttcgagcactgtgtagagcgcactggcgaacaccagtacacaggctcccagcaggccccccacgaccgccagggtcttcttgtacttcatcgcgcgcacgccgaaaaactgcaattcatttgcccgatctccttgaaaggcggctattgaacgaggtctggccaagccgatcaagttgcggcaccatccgccgccacaaaacgcctggtttccccgcccgcggcgcggaaacttctccggcagccaggatgcgcccatgcctcatcactcccgaatcgtcagcctgatgctgcaagtggccgtctggttggtgctgccgttcgccgccctgcaactgggcctggtattgacccgcgccggcgccgcgccctttgtctcggcagtggcggttcccaccggggtcctgtccctggtgctgatccagatcagcctggtgtatgccgccgccaaaggctggcacgcctgcgacatgcctgcccactatcgctggctgggcctgtggctgggttgcgtgctggtactgtgtgccgtgccgcagttcataccatcggcggggagcggcccatgaatcacaacggattcactcgggatgagtggctccgcctgctcacggccctcttcgcccactcgctggcggtactggcctttctcctggccaatcgctacggcattgcgctcgataacagcccgtaagcccgtttcgaaacccgcccccgcctactccagaccacgcgccaatacctcgatcagatggtccatcacccgccgcacggccgctgagcgacggacatcggcatgcaccgaaagccatagctcgcgagcatcgccagcacgcagtggcgctacccggaccaacccggagtcggggctggcgacaaaacagggcaacaacgcgaccccaacagcggcccgcgcagccgcctgctgggtgttgacgtcattgctacgcagaacgatcgggcgccgggcagcgaaatccaccaaccaacggtgctgcgggatatgttccagcgactcggcaaagccgatgaatccccagtcggcgggcggcgccgaggcataggcaggactggcataaaacccgaactggacctgaccgacccgacgcacgacgcgccccgcttcatcggggcgtacgtagccgatggcgatgtctgcctctccgcgctccagcgaagccacactggaggtcgtatccagcacgattttcagatccggatgggcggcacgcagcgccggcaggctgggtaccagcaacatgctggccagcaatgccagggtgctgacactgaccgtaccggacagccccacggcacctcgggcataacgatcgacctcgtcgaccagcctctctataggctgagcaatggccgccaacgctaccccggcttcggtcaaacgcgacgaacgtggcaagcgctcaagcagtttgagtcccaggctcgcttcaagactggacacccgtcgccctactgttgcgtgatcgacgcgcaaggcattcgcggcggcggtcagggaacccagccgagcaacgacgatgaagtgatgtagatcctgccaatcggtcataggtgcatattcgcagccttggtgtgcgcaagcacgcgttttttccttgatagcgccatcgtatcgtgacgtctaccgcggctacatcggccagcgattgctgaaggagaaacacttcgatgattctgttttatgcccctggagccagttcgctcgctccgcatattctgcttcaggtcagcgggctcggctttaccctggaaaaggtcgacctcacgaacaagcgctgggcaggtggtgacttcaacctgatcaatcccaaatcctacgtaccggtgctgcaactggagaacggccagcgactgaccgagtgcagcgtcatcctgcagtacattgccgataccgtgcctgaacaggcgctgctgccagccgtcggcagcttcgctcgctacgaagccctgcaatggctgagcttcctggccatggaggtacagaaaaacttcatcaccccggaacgtcacggcggcgtcagcgccaacttcctggcccgcaccgaggccggccaacaacagacccgggagcgggtgagcccgcggctggcgttcatcgatcaacacctcgctggccgggaacatgtgctgggcgacggtttttcagcactggacgcctatctgttcaccctgctgacctgggctcggcggctggccatcgacctcggacaatggcgccagctggatcgctactttgccagcctcaaggcccaccccgcgatccaccaggtgcttgaaacggaaggtccaccacatgccttgcgtcctgccgagtgattatttctgcggatgagacttgccaaatacgggccggaacccttctcgcctggccggcctggtgcaaaacccgctgaagatcaggccagcctgaggtacagatgaatatcctcgggctccaggcgatacaactctggatcgggtgccgccaacagctcgcagcccaggcggcggtagaaatccacggtgttgcgcgacggcgtggccgagacatacagcccctcgccacccatgcgccgtgcctgctcggcggccaggccgaacaaccgttggcccaggccgcgcccgcgatacgcctggctgacatgcaggaacttcagctgccgcaaccgcaggccggcgttgtggattaccaggcaatcgaccaccgccgcggccaccagccggtgttcgtcgaacaccccatacagccagccaccgcgctgttcacacgcctgcaagacccgcgcgtcatgctcggcttcgccgggcggccagccggtcaccacctcgcgcaggggataacccagcagttgcccgtcttgcaggcggtagaacgcctcgatcagctctgcacggtcaatcagtttgaacagcgggatgtcttgcgaggtcaaaaggcgttcattgagcatgtgggttttcctgaagccgtccgtggttttacgtatcggtagccgggcattttttgcctcgagcgaaccgattattctatccgcccgctgttaaaagtccgttgtgtttggccgaaggcatgaccgaacctccatttccgatccagcgcagccaggaagggctggggatctcctgacaaggttcacttatgcatcgcaggcatcttctgaaagcatccatggcgctggccgcctacaccggcctgtcggccacgggtctgctggcctcccgggcctgggcgggcgccgccgacggcgaggcgcaggccttcgatttcgagattctcaaggcccgggccaagcagttggccggcaagccctacgtggacaccaagcaggtgctgccgccgaccctggcgaccatgaccccgcagaacttcaacgcgatccggtacgacggcaaccactcgctgtggaaggagctgaacggccagctggacgtgcagttcttccacgtcggcatgggcttcaagcagccggtgcgcatgcacagcgtcgacgccaagacccggcaggcgcgggaagtgcatttccgcccgtcgctgttcaactaccagaacaccagcgtcgacaccgcgcagctcaagggcgacctgggttttgccggcttcaagctgttcaaggccccggagctggacaggcacgatgtggtgtccttcctcggcgccagctatttccgcgcggtggacaagaccggccagtacggcctctcggcccgtggcctggcaatcgacacctacgccaagaagcgcgaagaattccccgacttcacccagttctggttcgagaccccggacaaggacagcacccgtttcgtggtctatgccctgctcgattcgcccagcgccaccggcgcctaccgcttcgacatcgactgccaggccgagcgcgtggtgatggacgtcgatgcgcacgtcaacgcccgcaccgccatcgaacagctgggcatcgcgccgatgaccagcatgttcagctgcggcacccatgagcgacgcatgtgcgacaccatccatccgcagatccacgactcggaccgcctggccatgtggcgcggcaacggcgagtggatctgccgtccgctgaacaacccggcgaccctgcagttcaatgccttcgccgacaaggacccgaagggtttcggcctggtgcagaccgaccacgagttcgccaactaccaggacaccgtggactggtacagccggcgcccgagcctgtgggtcgagccgaccaccgcctggggcgaaggctcggtcgacctgctggagatccccaccaccggcgagaccctggacaatatcgtggccttctggaccccgaagacaccgctggccgccggggactcgctgaactacggctacaagctgtactggagcgccctgccaccggtgggcacgccgctggcgcgggtcaacgccacccgttcgggcatgggcggcttcgtcgagggctgggcgccgggcgagcattatccgccggtctgggcccggcgcttcgccgtggacttcaacggcggcgggctggagcggctgccggagggcaccggcatcgagccggtggtcaccgcgtcgaatggtcaggtcaaggatttccacgtgctgaagctggacgagatccagggttatcgcgtgctcttcgactggtacccgaccaacgacagcgtcgacccggtggaactgcggctgttcatccgcagcaacgatcgcaccctgagcgaaacctggctgtaccagtacttcccgccggcgccggacaagcgcaagtacagctgatgcagcaccatctgtagccgctgccgtaggctgcgatgggccgcgcagcggacccaggctcttcagtcgatccgcgtcgcctgatttgcgaccggttcccggtcgatcgcagcctgcggcagcggctacagctcgcggttgcacgccacggcacaaaaaaaccggccctcacaggccggtttttttatgcctccgcgcagctcactcgcgcagatccgactcgtgaatcggttggtcgcgatgggtcgcgcgctggtactgcgccggccagatcgccttgtgcccgctcaggtcgtcgtcggcatgcagcggccagtacgggtcgcgcagcagctcgcgggcgaggaagatgatgtcggcctgacaggtgcgcagaatatgctcggcctgggccggctcggtgatcatgcccacggtaccggtggcgatccccgactccttgcgcacccgttcggcgaagcgggtctggtagcccgggccggtggggatttcggcattgaccgcggtaccgcccgacgagacatcgatcaggtccacccccaatgctttcaggcggcaggccagctcgacggtttcgtccggattccagccgtcctccacccagtcggtggccgacacccggacgaacagcggcaactcttccggccagaccgcccgcaccgcctcacacacctgcaggaccaggcgaatgcggttatcgaaggagccaccgtactggtcgcggcgctgattgctcaggggcgagaggaattgatgcagcaggtagccatgggcggcatgcacttcgaccaccttgaaaccggcgaccagggcgcgtttggccgaatcgacgaaggcctggacgatcgcggcgatctgtccttcgtcgagctgggtcggcggcgtatgttgcgggtcgaaggcaatcggcgaagggccaaccgggacccagccgccctcctcgggcttgacgctgccatgcttgcccagccatggccgatgggtgctggccttgcgtccggcgtgggccagctggataccggcgaccgcaccctgggcggtgatgaaccgggtgatgcgttgcaagggtgcgatctgttcgtcgttccacaggccgagatcctgggcggtgatgcgcccgtcggcggtgaccgccgtggcctcggtgaaaatcagtccggcgccgcccacggcacgactgccgaggtgcaccaggtgccagtcattggccagtccatctacgctggagtactggcacatgggcgataccgcgatgcggttgagtaaggtcaattgacgaagggtatagggctcaagcagcagactcatggggcacctctcgatcagtggtcaggctccagggttctgtttgaaaagtcgacgagtgactggaaaggaacagcgcccgcccccgcgggagaaaaaggacaaaacgtcacaaggccaatcaagcagtgtttagagcctagtcgacaacggcgcgaccagcagggttccgacacattttgccgaggaaggtaacggtggcctggcgttctttcgcgagcacgctcgctcctgcagaagcaacacaatccctgtaggagcgagcttgctcgcgatagcgccagcagccttaacgcggttcgatatgggcgatcatcagttgcaccgtttcctggccgcggaactcattgaggtccagcttgtaggccagctccacccagcggatggtcgggttcggccagatatcgcggtcgatgccaaaggcaatgccatcgagtttcaccgaaccgcattcgctgcgcagcaccaccttgaggtggcgctcgccgacgacccgctgctccaccagttggaacacgccatggaacaacggctcgggaaagtgctggccccagggcccggcatggcgcagggcgcgggccagttcgaggtggaactcttccaccgccagagtgccatccgacagcaggcgcccggtcaggtcttcctcgcgcagctggcggcgcacctcggtatcgaaggcctcggcgaaggccgggaaattctgctccggcagcgacaggccggcggccatggcgtgaccgccgaacttgctgatcaggtccggatgtttggccgccaccgcgtccagggcatcgcggatatgaaagcccggcaccgaacgcgccgaccccttgagcatgccgtcgccggcgtcggcaaaagcgatggtcggccggtggtaacgctccttcagccgcgaagcgagaatcccgatcactccctggtgccagtcgggctcgaacaggcacaggccgaacggcatcgattccaccggcaagtccttgagctgggccagggcttcgcgctgcatgccctgctcgatggatttgcggtcctggttcaactcatccaactggctggccatttcccgcgccagggccatgtcatggctgagcaggcattcgatgcccaggctcatatcgtccaggcgaccggcggcattcaaccgtgggccaaggatgaagcccaggtcggtggaggtgatgcgcgacgcctcgcgcttggccacttcgaggatcgccttgatccccggtcgcgcgcgcccggcgcgaatccgctccagcccctggtgcaccaggatgcggttgttggcgtccagcggcaccacgtcggcgacactacccagcgccaccagatccagcagctcgccgatattcggctgcggcttggcttcgtaccagccaaggctacgcaggcgggcgcgcagcgccatcagcacatagaagatcaccccgaccccggccagcgccttgctcgggaactcgcagccgggctggttcgggttgacgatggcatcggccgccggcaactcgtggcccggcaagtggtggtcggtgaccagcactttcagcccggccgccttggccgccgccacgccctcgacactggaaatgccgttgtccacggtgatcagcagctggggcttgcgctccagggccaccgcgacgatttccggggtcaggccgtagccatattcgaaacggttcggcaccaggtaatcgacatgggccgcgcccagcaggcgcaggccgagcagccccacggtactggcagtggcgccgtcggcgtcgaagtcgccgacgatcaggatgcgttcgcgctgctccagcgcggtcaccagcaggtccaccgcggcctcgatgcccttgagctgctggaacgggatcagccgcgccaggctcttgtccagctcggcctcggactgcacgccacgggcggcgtacaggcgggtcagcaacggcggcagatcaccgagaaacggcagggtggcgggcaactcacgaggttcgatacgcatggggtgacagaagcttctcttcgatacaggggatacggcgaaacagcgcgcggcgtggcgaactcagcgttcgcccaacagccattccagctggacttcgtgctggccgcgatcgtcggtgacgaagatcgtgccttcgctgatcatcacgtcccacttgataacgcgcggcatgtccttggccaggacttccaggacgtcctggggcacgccggcgatattgaggttcttcaggttcttcactgcgtccactacgcgggtctgccacacgcgcaggctgccgtaggccagcaggctggtgcgctcggtacggcgcgaacaccaggtcaggcgctcggcgtccggctggccgacttcgatccagtgcagcacgcggtcgtccaggcttttttcccacagcgccggctcatccacttccgacaggccacgaccgaacgacaggtgttcgttgtaccaaagggcgtaggccagcagacgcacggtcatgcgctcttcggtttccgacggatggcgggcgatggtttgcttgacgctttcgtacaccccgcgatcgaggtcagtcaggttcaattcaaacttgtaggtggtagacggctgggccatggacggggcttcttgatacgaggaaaggcggcaagtctaaccgatgcacgagccaatccacgaatcgcgcaccatcatcctttggcgagggagcgccgggctatgttaaaacgctctaccgtccaatctttgtcctacaaggatcttccatgccgcttaccgccaaaccccttgccggcctgaaagtcgtcgaactcggcaccctgatcgccggcccgttcgcctcgcgcatctgcgccgaattcggcgccgaggtggtcaaggtcgaatcgccggacggcggcgacccgctgcgcaagtggcgcaagctgtatgaaggcacgtccctgtggtggttcgtccaggcgcgcaacaaaaagtccctgaccctgaacctcaagcacccggacggcctggaggtgctgaagaagctgttggccgaggccgacatcctgatcgagaacttccgccccggggtcctggaaaaactcggcctgggctgggaaaccctgcatgcgctcaatcccaagctggtgatggtgcgcctgtccggcttcggccagaccgggccgatgaaggaccagcccggtttcggcgcggtcggcgagtccatgggcgggctgcgctacatcaccggtttcgaggaccgtccgccggtgcgcaccggcatttccatcggcgactcgattgccgccctgtggggcgtgatcggcgcgctgatggccctgcggcaccgcgaggtcaacggcggccagggccaggtggtggacgtggcgttgtacgaagcgatcttcgccatgatggaaagcatggtcccggagttcgatgtcttcggcttcatccgcgaacgcaccggcaacatcatgcccggcatcacgccctcctcgattcacaccagcgccgatggcaagcatgtgcagatcggcgccaacagcgatgcgatcttcaagcgcttcatgcaggtgatcggccgcgacgacctggccaacgacccggccctggccagcaacgacggccgcgacagccggcgcgacgagctgtacggggtcatcgatcgctgggtcaactcgctggcgctggagcgcgtgctcgaattgctgaaccaggcagaagtccccgccagccgcatcttcagcgccgaggacatgttcagcgatccgcagtttctcgcccgggaaatgttcctccaggccaagctgccggacggcaaggcattcaagatgcccggcatcgtgccgaaactctcggacaccccgggctcgtccgaatgggtcggccccgcgctcggcgagcacaatgcccaggtgctgggcgccctgggctacgacgagcagcagatcaaaagcctgcgtgacaacggcgcgatctagttttgaaaaacgatgccttttaccgacaaggatcagcagcctgatgaccccatgccgtagcaggcgaatgattcgtggcatacgcctgttgtcgatgctgctggcgctcggcgcctggtcaccggccagccaggcccgggacacgctgatctgggtgttgcgcgacttgccgccaacgacgattttcgaaggtccgcaaaaaggccgtggggtgatcgatcaggccttgcctgtgctgatggccagcctgccggagtacgaccatcaggtcgtgcacgtcaaccgcgcccgtggcatgcagatgctccgggagcaacccttcgtttgcgatccggcactgatgttcaacctgcagcgggcgcagtggatcgcgttttccatcaccagttttcgcgtattcagcaacggcctggcggtgcgtcgccaggacagtgacagcctgcagccgtttatccacgatggccagatcgacttgcgcgcgctcctggccagcgccccgcacaacgttggcgtggtggccgagcgcagttatggcgagccgatcgacagcctgctcgcacaggcgccgcccggagccctgatggcccactacggcaacagcgccatcggcaacctgctgcagatgcaaaggcacggacgcctcaaatccctgatcggctaccagccggagattcgcttccaggcgcaacagcaagggatcgacccgagcgagctggcgttctacccgatccaggacatgcccaggtatcaatcggtgaatgtcggctgttcgaacacagcgcagggccggcaggcggtggagcgcatcaaccgcgcgctgctcgaactgcgcccggacaccttgctggagctttatgcccagtggctggaaccgtcgctgcgcgagcaataccgcagcgatgccctggcgtttttccacgacgcgccgcagcgctaaaaaatccgggcaaaaagaaaccccgagcagtggggagacaactcggggttaaacgtggtctgaaaccagacccgtgcaacaagcgacaagcaccggagcacaatgctcgatcctgttgccaagggtctgactgatgggctgaagcgaaggttcccgaaaatttccaatcagcgtgcgctgtcgaacgccttctccctggccacattgcgcaaggccgcgatgacacagggttccaggcgaccttcggcgatcaatacgtcgcgatgcagaccgtcgacgacatcggtcaactgacgcttgtcggtcaactgggcctggctgaactcgcgctcgaccacgatggcccccaaggcattcttcagggtcaccaggcattccccctgcgcgcgcggggtcagagttacctgatacgggctcaaagcttcacccaacaataggctgatactttccatctcgatcaccactcaatagctggaattaaggctcgaatacacgaatgccggtagctttctggcattcaagtgaccatcgcccagagaagaaagttcgcaaccgctggcggttgccgacctgagtcgatccagcatgcccgcaaaacatgacagataaaaaacagcccggatcagactagaatcggcactcaaaccagaaacgaacgcgacggtgccggcggatcgatcagcgcctcgactttcttgtagcgcaataccgcctgttggcaggaatagcgccgaggatcgatccggaccggcatcgcgacctgctcccgaggcggactttcaggcctggcgcaggtctttctggcaggtgggggtgtggccatgggggccctctcctcgagcggttggcaaagcccggcggcgcagcgatgacggttgcccggttgcagggcctgtccgaaatgctgccttctcagcggagcgagtcttgaatcaaacgtccaataaaaaactgcggatcgtcctggccgacgatcacccgattttcctcatcggcctgcgggccgtcctggagcgcgacgacaacctggagatcgtcggcgaagccagctccccgaccgccctcggcgaactgctgcaaagctgtccctgcgacgtactggtcaccgacttcatgatgccgggcgaacagcagaacgatggcctgcgcctgatcgagcaactgcgccggcatcatccccagctgccgatcgtggtggtaaccatgctcaacaatgccggcctgttccgttcgattctcgacctgggagtctcgggcctgctgagcaaggccagcctggccgacgagctgccggcggcgatcagccatgtgcgccgcgacaaggtgtttgtcgcccaggccatccagcagctcctcagcctggcgggcgaggtcgggccggatcgcttgttgtccggggaacagctgtcgccccgcgagctcgaagtcatccgcctgctggcggccgggctgacggtcggggaaatcgccgcgaagctcagccgcagcaaaaagaccgtcagcacccagaaggtcagcgccatgcgcaaactcggcctgtccagcgccgcggcgctgtacatctacgtgcaggaacacgggctcgcctgagcccgggctcagccggcctattcgtcgaggtcgtcatgcaagcgccgggcgatccactggcgcacggcgacggcgctcatgggctcggcgacgaaacagccttgcaggcgcgcctgccccagcttcttggccgcctggtagtcggcggcgctctcgatacccgccagcaccacgcccagcgacatgcgccgggccatgctcatggcgccggccaccacggccgccttgcgctcatcgtcagccagcccgcagacgaaggccggcgggatcttcagctcggtgaacggcaattccaacagacgctgcaggctggtgccgccggtgccgaagtcgccaatcgacagcttgcagccgatcatgcgcaggcgcagcagggcctccacatgggcgatatcggtttccagttcggtggtctcgacgatttccagggtcagcaggcgtgccggcacttcaaaacgccgtagcagggtttccagctggcgcgcgaagttcggcagttccagcatgcccaccgggatattcaccgagatcgccagcgagcggcccatgaccaggcgcaccccggccgacagttgcagggcctgctccagcatgagccaggtgaaggccttctccaggccggcgaactcaatcactggaaggaactcggcgggcagcatcaagccgtgttccgggtgctgccagcgcgccagcgcctcgacgcccaggacctcgccgtcctggctgaccaccggctggaagtgcgcaaccccatggcgcagtaccaccgcctgcccttcctcggcggtcggcatctccggctggaacacatccagggccagggtttcgcgcacctgggccagcgacaagtcttgcggcccaggctcgaaacattgctggtacaggcccagcagttcattgagcagggtgaccgaggccggcttgggcagacagcccagcacattcaggccctgctgccgggccatggccgcggcgccttcgcggacatccgcttgcgcgtcgctgagaatgatcagcgccctcgcccgttgctgctctgccaggtaacgaatcagctccaggccatcggcctgctccaggtacagatcgcagatggcgatatccaccggccccttgctgtccagggattgccgggcggcggcaacgctttcggcattcaacacgttgaacacgccattggcgttgagcatctggtgcagggccatcaactggaacgaattgtcttcaagaacgagcactttcaacctgtgcatggaacgacctccgatacggcgagagcggcgagaatccgcagcggaccggtacgttaatcgcagcgggcaggccgccccataagacaagtcttaatcgctacccaggtatggctcgatatcgctgcgcaagcagccgatggcctccttcaggcgcaaccagtgctccgccagcaccgccgtcgagcgagcccgggcaacggcctccaggtcgatgcagacctgggccagtggcagcgcatcgatcaggcagcacacccctttgaggcggtgcgtggaggcgccgatacgcgcccagtcctgctccagcaccgccgactccagggccgcctgctcctgccccaggttgctccacagctcgcgcagcatgcgttgcagaatcggctcgtcggcctgggtcatgctgcgcaaggtctggatgtcgaaggacggcggcggcaagaagcgcgccagcatctgcgccagccggtccagggtcaccggcttgaccagcagttcatccatgccggcctgctcgcagcgttgctgctcatcctcgaaggcattggccgtgcaaccgatcagcgggcaggcgtcacgcccttcccgggcctcgatctgccgtatcgcttcgctcagctgataaccgctcatgcccggcatgtggcagtcggtcatcaccaggtcgaacgcctcgccctgccagcgcgccagtgccgcctcggcgctgtcgagcgccaccaccttgtgcccgaggaacatcagttgctggctgagcaccatgcgattggcgcgcacgtcgtcgaccaccagcaccgacatgcgacggctctgcgggcgctcgcgggtcacctggggcgactggctgaaatcctcgaccacctgttccgggtacagctcaagggtcacggtggttcccacgccgggttggctttgcagcagaatgcgcccgcccatcagctccaccagttgcttgcagatactcaggcccaggccggtgccgccctgctccggcgtcgtctgcagatgggcctgaatgaatggatcgaacaggctcgcctgcttctcggggctgatgcccgacccggtgtcggccacgctgatgcacaaacggtcggcgccatgttcatcggcctggcgctccacggacacccgcacctcgccggcctgggtgaacttcagggcattgctcagcaggttgtgcagcacctggcgcaggcgcagcgggtcgagccagtagaagccgtccgccgccttgtcgaaggccagcgtcaggtgcagccccttgttgcgcgcggtgacctcgaacaattgctgtatgtcttcgaagaagcctcgcagggccacggtctgtggcgccagctgcatgtgcccggcctcgatcttggccaggtcgaggttgtcgcccatcaggccgaccagttcctgtgccgattggtaggccacgcgcagcgcatcggaaaacggcatgccgcgcaggcgcgcctgttccttttccagttccagcaaaccgatgatcgcattcatcggtgtgcgtatttcgtggctcatggtcgagagaaaggcgctcttggcgtagttcgcctgatccgccgcgcgacgcgcttgcagcagctcttcctccaggcgcttgcgctcggtgatatcgatccagccccccagcaacccctgcaattcaccctgggcgctgtagaacggcaccgtccattgatagacatgcaccgggccccttctggactcgatctgacggtcgacgaacaccgactcctgggattccagcagctccaggaactcgcggtgcaactgccgggccgtggcctcgggcaagacatccagctcggtcaggcacagccccttgatctgttccaggcgcatgccggtctgggtttcgtagcttttgttgcaggtgatcaggcgcccggccaggtcgcgaacgaagatggggttggggatcccgtcgagcaaagcgcgcttgaacgccagctgatcgttgaggcgttgctcggcttgcagacgctggcggatctgccccttgagccgggtgttccaggccagggacagcaggccgaacaggatggcggtgaaggtgacccagtagatccacaccggtacccgctgccacatgggtaccggcaccggcgtcacccccagccacttcaggccggatggcgctgagctcggccaccgggaaggcctccagggccttgttcagaatgctcagcagctcgggctggtcccggcgcaccgacaactcgtcggccgaccacttgccttcgacgctgcggccgatgcgcagcccgttcgccggatacccctgcacctcgacttcattctggatggtcgcgtcggcctcgccattggccaccagggcccgcgcctcttgataggtagcgaccgaacgcaggcggacctttgggtagttctgccggacgtagctctccagcgcatgcttggccggcagcgccagcaccctgcccgccaactggctgaaggtgttgagctggatgtcctcggcgcggaccacgaacacccaggccgaaccgccaaaggggtgggtgaagtcgaggaagccgcagcgctcgtcattggccgacaaggtggtgttcatctgggcccggcccttgagcagcaggtccagggtatgggtcgtggaaaagctttcctcctggatgaactgcaggccggtcattctcgagatgcggttgagcaagtcgatgttcagcccggtccactggccgtccttgtccttgaacacatagggtgggtactgctgggaagccactaccacatgctgatgttcgagcagccaggcgcgctccgccttgctcaacttgatccgctcgtcgctggtgctggcgcccagcccggtggtccagcgggccaggatctcccgatccgtggagtcgtcgatgctctccagcgctcgctcgatcaggcggttcaacaacgggtcgctctggcgcgtggcgaaggcaaagccgatcggcggcagccggctttcggtgcggatctgcaaccccaggtaagggcgcagcgccttgtaggcacggacgatcacctcattgccgataaaggcatcgacatccccctgcttcagcgcttccaggccgctgtacagattgggcgagagaatgatctggctgtggggataagccgcgtgggcgaccttcgcgtccgcatagccctccagcagcaccactttcttgccggccaggtcttcgggaatttccgcctcgtcccggcgcaccaccacgaccgcgcggtcgggcatgtagtcactggaaaaatgcagccccgcggcgccacgctcgtagccgttggcgctggtcaggatgtcgatcgcccccgtgcgcaacgcctcgaccgcctgttcacgctcagagaaccccaggacttccagggacacgcccaggcgttcgccgaccaggctcaggtagtcggcgctgatgccctggtaacgattgcggtcgcgcgtgatgtcgatcggctggtagtcatcgatcgaaatgcccaccttcaaggtgccccggcccgccagccattgccgttcggccggggccagggtgagcggctccagttcgacgaaggccggcaccagcttgaagggcaggttctgcgccgccatcaggcacggggccagggccagcgtcgccaaaaccatcaatgtgcgcaaaaccgggcgcagcaacataagcatcctgtgaatgatcctcgacgcgtcgccgccctgtccttgatgctccgtccttgagctccgtcattgaaggcacgccgcgataaacagcctgtgtataaaaagacaaggcccgtcagagacgggccttgttgacgatcgatgtcagtcgatcagagcggtttgccgcgattgccgtgctggctgacgaaggcctggacggccttcaggtcgttggccaggacagtgcaacgctcttcgcgctcgaacagatcggacaggtgcgctggcaattccagggccttgccgatcccggcctgctccaccgcttccgggaacttcaccggatgcgcggtgcccagcaccaccatcgggatgtccaggctgcgacggcactcacgggcggccttgacgccgatcgcggtgtgcgggtcgagtacttcgccagtctgggcgaagacttcggcgatggtctcgcaggtctgggcgtcgtccacggccagggagtcgaacagcttgcgcgcttcggtccagcgctcctgctcgacgctgaaaccgccaccctgcttgaaggagtccatcagctgagccagcgcggcaccgttgcgaccgtgcaggtcgaacagcaggcgctcgaagttcgacgagaccatgatgtccatcgacggcgacagggtcgcgtgcagggtttccttgacgtactggttgccgctcatgaagcggtgcaggatgtcgttgcggttggtggcgacgatcaactggttgatcggcaggcccatgttgcgcgccaggtaaccggcgaagatatcgccgaagttgccggtcggcaccgagaacgccaccgaacgcgccgggccgcccagctgcagggccgcgtggaagtagtagacgatctgggccatgatccgcgcccagttgatcgagttcaccgccaccaggcgggtgcccttgaggaagccctggtcggcgaagctggccttgaccatttcctggcagtcgtcgaagttgccttcgatggcgatgttgtggatgttctcgccgaagatggtggtcatctgccggcgctgcacttcggacacacggttgtgcgggtgcaggatgaagatatcgacgttgtcgcagcgcttgcagccttcgatggcggccgaaccggtatcgccggaagtggcgccgatgatcaccacgcgctcgccgcgcttctccagcacgtagtccagcaggcgacccagcagttgcagggcgaagtccttgaacgccagggtcgggccgtggaacagctccaggacccactcgttgccgttcagctggcgcagcggggcgatggcgttgtgggagaaagcgccgtaggtttcctcaaggattttcttgaagtcggcatccggaatgctgccggtgacgaacgggcgcatcacccggaacgccagctcgtgatacggcaggccggcccaggaagcgatttcctcctgggtgaaacgtggcaggttttccggtacgtacagaccgccgtcgctcgccaggccggccagcaggacgtcttcgaaattcagggccggtgcctggccgcgggtgctgatgtaacgcatataagcaaacctttgatgtggagctgcaagcttcaagtgacaggcgacaagtcaaagcgaatcggcttttacttgcagcttgcggcttggcgcttgccgctgaattaattcagatgttcgacacggatccgcacgaccggaccgaccacgccctgcagggcttccagcgcggtgatcgcatcgttgatgcgctgttccaccacacggtgggtcagcaggatcatcggcaccaggccgtcgtgttcttcgacctctttctgcatgatcgactcgatattgatgccgcgctcggacaggatgctcgccacctgggccagtacgcccgggtgatccttggcctggatccgcagatagtaggcgctttcgcaggcctcgatcggcaggatcgggtgcgccgacagcgagtccggctggaaggccaggtgcggcacacggttttccgggtcgctggtcatggcacgaaccacgtccaccaggtcggcgatcaccgacgaagcggtcggctccatgccggcgccggcgccgtagtacagggtggagccgactgcatcaccgttgaccatcaccgcgttgaacacgccattgacgttggcgatcaggcgatcggccgggatcagcgtcgggtgcacgcgcagctcgatgccggcatcggtgcggcgggccacgcccaggtgcttgatgcgatagcccagggcctcggcgtagttcacgtcggcggtggtcagcttggtgatgccttcggtgtaggccttgtcgaactgcagcgggataccaaaggcgatggacgccaggatggtcagcttgtgcgcggcgtcgatgccttcgacgtcgaaggtcgggtcggcttcggcgtaacccagggcctgggcctcgaccagcacgtcttcgaaggtgcgacccttctcgcgcatttcggtgaggatgaagttgccagtgccgttgatgatcccggccacccagttgatacggttggccgacaggccttcgcggatcgccttgatgactggaataccacccgccacggcggcctcgaacgccacgatcacacccttctcacgggccttggcgaaaatttcgttaccgtgtacggcgataagcgccttgttggcggtgaccacatgtttaccatgctcgatggccttgagtaccagctcgcgggcaacggtatagccgcccatcagctctatgacgatgtcgatctcagggttcgtggccacttcgaacacatcgttggtaatcgcaataccggtcgtttggaactgaggctttggcgtgcgcatggcaatttgtgccacttcgattccacgcccggcacgacgagcaatttcctcggcgttacgctgaagtacattgaaggtaccgccaccgacggtacccagcccacagatgcccactttgaccggattcactctgaactccccatgaaacggccgacactaggtcggccgtggaaaacagccgcaaaccacacggctctctattaatgacgcgtcggccacaaccgccgcgtcatgatcgtcaaaggctcgacgacgcaggattatttcgcgcccagcgccagtttggcgacttgtggcgcaggctggtagcccggaatcacttggccgtcggccaaaacgatggccggcgtgccgttcaccccgatcgactggcccagggcgaattgcttggaaaccgggttggcgcacttggcggccttgatttccttgccatcgaccatcttgtccatggccgctttcttatcggccgagcaccagaccgcctgcaactgctcgtcgcccggcgaacccaggccctggcgcgggaaggcgacataacgcacttccacgcccatcttgttcagctcgggcacttcggcgtgcagcttgtggcagtacgggcaggtggtgtcggtgaagacggtgatgtgggtcttggtttcgccgatggccgggtagaccacggtttcagcgaccggaatggcgttgatcagcttggccacgcccaggcgctcggtcttttcggtcaggttgaccggcttgccgtccttgagctggaacaggtagccctgcatcacgaactggccgtcggcgctggcgtacagcacgcggctgcccttgagcttgacttcatagacaccgggcagcgggctggcgctgatgctttctaccgggacttcgagctgcaggccctggaggcttttacgaatcgctttttcggcggcgtcatcggccataacaaaggtactggccaacgcaatggctgcggcggcgattatctgggtcacgcgcattgggaactcctgaaggcggacaaatgggacggtcagaacgcccgtactggaacaccgggtcataacggcccactttgtaaaccggcaaagcctaccacataaggcccgcctggcgggctcccgctgagccaagccggtcatttgccgatcggcgcggaaccgcttccgggtcgccgcagccggcgctcgcggcgaccgacaccccactcaaccgcggggatggtgcttggcatgcaggtcctgcaaacgggcccgggcgacatgggtgtagatctgggtggtcgacagatcgctatggccaagcagcatctgcaccacccgcaggtcggcgccgtggttgagcagatgggtggcgaaggcgtgccgcaaggtgtgcggcgacagcgacttgccgatcccggcgaccttggcctgatgcttgatccggtgccagaaggtctgccgggtcatctgctcgccacgctggctggggaacagcacatcgctgggccgcccgccgagcagctcgccacgggcatcgcgcatatagcgctcgacccagacaatcgcttcctcgcccatcggcaccaggcgctccttgctgcccttgcccatcacccgcaacacgccctggcgcaggttgacctgctccagggtcaggctgatcagttcggtcacccgcaggccgcaggcatacaggacctcaagcatggcgcgatcgcgctggccgatagcctcgctgaggtcgggagcggccagcagggcctcgacatcggcctccgacagggacttgggcaacggccgccccagctgcggcatgtcgacttgcagcgtggggtccacggcgatcagtttttcccgcagcaggtaacggtagaagccgcgcaccccggagagaaaacgcgcggtcgagcgtggcttataggcctgctccacccgccaggcgaggtggtcgagaatcagctcgcggccggcattcaccagctccagccctttctcctgcagccagccgttgaacaacgccaggtcactgcgataagcctcccgggtgttgtccgaaaggcccttttccagccatagcgcatcgaggaaacggtctatcaggggatgatcgatggcaggcataaatactcgaaaggcgcggccttgaggccgggcgcaaataaatagtgaactgtgcagagggtcgctagtctttcatagcccgctatttcaaggaacagggagcttcaatgaacgaacaacagattctgttggcctttggcggcataggcgtggcggcagtgggctgccaatggctggcctggcgcctgaaactgccggccattctgttcctgctgttgagcggcattctcgccggcccggtcctgggctggctcgacccgcaggaactgttcggcccgctgctgatgccactggtgtcgctggcggtggccttgatcctgtttgaaggcagcctgaccctgcacctgtcggagtggcgtgagatcggcaaggtggtgcaccggctggtgaccatcggcgccctttcgacctgggcggtgatcaccctggccacccactggctgctgggcttcgactggctgctggcgctgctgttcggcaccctgaccctggtcaccgggcccaccgtgatcgtacccatgctgcgggtggtgcggcccaaggcgtcgatcgccaacatcctgcgctgggaaggcatcgtcatcgacccgatcggtgccctgctggcggtggtggtctacagcttcatcatcgcgagcgccgagggccagggcctgcagcacagcctgatgaccttcggcggggtgatcctctgcggcagcctgttcggcatcgtcggcggctgggtactgggcaccatcatgcgccgccagtggttgccggagtacctgcacaacctggccacgctggcggcggtgctgggcatcttcatcggtgccaaccaggtgatgcatgagtccggcctgctggccgtgaccctgatgggcatgtggatggccaacatgagggacgtcgatgtccggcacatcctgcacttcaaggaaaacctcagcgtgctgctgatttccgggctgttcatcctgctggcggcgcgcctggacctgcatgccctgatcgccctggggccgctggtgttgattctgctgctggtgatccagttcatcgcccggccgttgaacgtactgctgtccaccgctggctcgaacctgagctggcgcgagcgggctctgctggcctggatcgcgcctcggggcatcgttgccgcggcggtctcggcgatcttcgccattcgcctggaccaggccggccatgaaggggcgctgctgctggtgccgctgacctttgccgtgatcatcggcaccgtggtgctgcaaagcgccaccgcgcggccgctggcacgcctgctgaaggtcgcggaaccggcgccaagcggcttcctgatcgtcggcgcaaacgctccggcgcgagccatcggcaaggccctgcaacaactgggcagccgcgtgctgctgaccgattcgagctgggaaaacatccgtgccgcgcgcatggacggcctgccgacctatttcggcaacccggcatcgcaacatgccgatgcccacctggacctggtggggcttggccatctgctggcgctgtcgccctccggcgaattgaacaccctggcctccatgcgttttcgccacgacttcggccatcagcgcctgttcggcctggccaacagccaggaaagccggcgcaccgacaagcaccgggccagccatgaacatcgcggacacctgctgggtaacgagactctgtcctacagcaaactggccagcctgctgggacagggtgcggagctgtacagcaccaacctgaccgaaggttttggctgggaggattaccaggcgctgcatggtgagcgggcgaccctgctgttcgctcgcgacaacagcggctgggtgcatgtggtgacgccaggcagcgccctcaagccctccgcgggatggaccctggtggcgttgattcagaaggatacggcggcgggctgaaacacatcgccggcaagctcgcgcccgtaaccgcgagcttgcttttgatcaatccactatcagtcgacaaaccccggcagcaccggtaccgggcgcttgtcatcatcgatggcgacaaagctgaacaggccatggatggccttctctcgcccatcgcagctcatgctctcgacgaacacctcaacctcgaccttgaggctggtattgccgaccttcaccacccgtcccaccagctcgacgatggaacccgcggcaatcgggtgattgaagtcgatacggtcggtggacacagtgaccagcggcaaccggcagaaacgggtcgcggcgatgaacgacacttcgtccatccaggccagcgccgtgccgccgaacagggtgttgtggtggttggtggtcgacgggaataccgccttggtcacgcgggtcaccgacagctcggtccggcgttggatctcttgctcgcgggggctcatggttctactgcctgaaacacaattcggggataaatgacgggcaacaaaaaagcagcccgtaggctgcttttttctgcatcggaagctgggcttaaaccagtttttccttgatgcgagctgctttacccgacaggtcgcgcaggtagtacagcttggctttacgtacgtcaccgcgacgcttgacagccatgctgtcgatttgcgggctgtaggtctggaaagtacgctctacgccaacaccgttggagattttacgaacggtgaatgcactgttcacgccgcggttacgcttggcgattacaacgccttcgaacgcttgcagacgggaacgatcgccttccttcactttcacctgaacgacaatggtgtcgcccggggcaaaggctgggatctctttggtcatctgctctgcttcgagtgcaagaatgattttgttggtcatgctgtgctcctaaggtaaatcgtcggatctaccatcgatacgttgttaactatcgtcccgctcgcggatgtattcctcgagcagcttcttctcttctccagaaagcgagcggctttccagaagatcggcgcgtcgttcataggtccgaccaagggactgctgtaaacgccaacgccggatgtgtgcgtggttgccactcagcaacacgtcgggaacacgctgatccgcatacacctccggtcgggtgtagtgcgggcaatccagcagaccatccgtgaaggaatcctcctccgcggaatccgcatgccctaaagctccgggcagcagtcgcgtaaccgcatcaatcaggaccatcgccggcagctcgccaccggagagtacatagtcgccaatcgaccactcttcatcgatatgagcttcaataaaacgctcgtcaatgccttcataacgaccggcaatcaggatcaatgcatcctcattcgccaactcgcgtaccgccgactgagtcagtttgcggccttggggcgacaggtaaatcaccttcgcgccctccccggctgcctgcctggcctgaaccagagcatcttccaggggcttgatcttcatcaccatgcccgggccaccgccaaatgggcgatcgtccacagtgtgatgtcgatccgtggtgtagtctcgcggattccaacaggtcagctgcaagagcccctgtttcaccgcgcggctggttatgccgtagtcgctgatggcggaaaacatctcgggaaacaaactgatcacttctacgcgcaggctagccacgttcagaagtccgcgtcccaatccaccttcatctcgcccgctgccaggtcgacggccaacacgcattgctcggtatagggcaacaggcgttcgcgatcatccaggctgccagcgcaaggcttgaccaccattacatcgttcgagccggtctccagcaggtgatcgatcttcccgaacagttgtccgtgagtgtcgatgaccttgagaccttgcagctggtaccagtagtactcgccgtcggtcagttcagggaacaggttgcgcggcacgcagatctcataaccggccagaagacgcgcttcttcacgatcatcgagacccttgagctttgcgaccaggaatttttcattcccgcgtccgctgaccagctcaacctgtttcacgctaccttcgcgcttgagcgtccaggttttgtaatccaacaggtttttaatcggatcagtaaaggaataaaccttcacttcgccgcgaacgccgtgaacagagtagattttgccgataacgatcaaatcatcagcaggagcaggcgtcgcgttcatagggttcaggctgcagccttagccgattccttcaacagctgagcaacgcgctcagacggttgtgcaccaacgctcagccagtaggctacgcgctcttggttcacggacaggcggacttcttgaccacgagcgatcgggttgaagaagccaacttgttctttgtgcgaaccgtcgcgtgggttgcggctgtcggtcacggtcaagtggtaaaacgggcgctttttggagccgccaagggcaagacggattgttagcatgtgaacatcgttcctgtagtcggtgctgcaaatctaaatgcacagcgggcatgggtgcccgaaaggccgcatattctaaggaatatccggacttttgcaaatgactttttccggcgcctaccggctgccatccagatttgctatagggccgttggcaacaacggcgagtcagctcccgccaagcgcgggtttgctggaggtcccgcgtccccgcgggaaacgccggcatggctgccggcgtggattcttcagatcttcggcatgccgccgccgggcaacattccgcccatgccgcgcatcattttcgccatcccgcccttggcggagaatttcttcatcatcttctgcatctgcttgtgctgcttgatcaagcgaccgatgtcctgcacctgggtgccggaacccatggcgatccgacgcttgcgcgaaccgctgatcagctcggggtcgcggcgctcggccggggtcatggagttgatgatggcttccatctgcttgaactgcttctcggccgcgccctgggcattgcccatttgcgccaggttcacgccaccgatattcggcagcttgtccatcaggccaccgaggccgcccatgttcttcatctgttgcagctggtcgcggaagtcttcgaggtcgaagcctttgccttttttcagctttttcgccagcttgtcggctttttccttgtcgagggtctgttcggcctgctcgatcaggctgagcacgtcgcccatgccgaggatgcgcgaagcgatacgctcagggtggaacggctcgagcgcttcgctcttctcgcccataccgatgaacttgatcggcttgccggtgatagcacgcaccgacagcgcggcgccgccacgggcatcgccgtcgaccttggtcaggatcacgccggtcagcggcagtgcgtcgccaaaggccttggccgtattggcggcgtcctggccggtcatggcgtcgaccacgaacagggtttccaccggcttgaccgccgcgtgcaacgcctggatctcgtccatcatgtcggcgtcgatgtgcagacgaccggcggtgtcgacgatgaccacgtcgatgaacttgagcttggcttctttaatagccgcttcggcgatcgcgaccggcttctggctcaggtcggacgggaagaaggtcacgccaatgtcattggccagggtttcgagctgcttgattgccgccggacggtaaacgtcggcggaaaccaccatcacgctcttcttcttgcgctctttaaggaagcgcgcgagcttgccggcggtggtggtcttgccggcgccctgcaaaccggccatcagcacgacggccggcggcacggcgctcaggttcaaatcttcgttggccgcgcccatcaggctttcgagttcggcctggacgatcttcacgaacgcctggcccggggtcaggctgcgcgacacttcagtgccgaccgcacgttccttcaccgagttgacgaaatccttgaccaccggcagggcgacgtcggcttcgagcaacgccatgcgcacttcgcgcagggtgtctttgatgttgtcctcggtcagcttggccttgccggtgacatggcgcagcgtctgcgagagacggtcggttaggttttcaaacatgcgcgatcctttcaggccctaagtagaccgaggtaatggcggctcgggccccctatataaagaggtgctccgtgggcaggtcgcggattatagcgaagactgcgtgcgacgcacagccgccgtctggttgcacggtctttcgtgtgatggcggttctatgccaaactcaacgactttcgggcttgcctaacaggatttatgctccccttgtcacccagcttgctaaccaccctcgccgccgcctgtctctatgccgctgcgaccctctatcaaggcactcgtctggctcaagccgccaagacgaacaagcgcctgctggtctcgctcggcatccttgccctgctcgcccacagcgccagcctcctgacccacctgatgacgcccgtgggcctgggcctggacttcttcagcgccgccagcctgatcgccgccgcggtgattgccctgaccctgctggcctgctcgcgcattccggtggagaacctgctggtcctgctgtttccgctgggggcgctgaccgtgctgctggcgcagttcgtgcccaccggtacggtgccggtgatcgacgaagagccaggcatcctcgcccatatcctgctgtcgatcctcgcctacggcatgttcaccatcgccgtgttccaggccctgttgctgctggtgcaggaccaccagctcaagcacaagcacccatccgggctgatcaagaactttccgccgctgcagaccatggaaagcctgctgttcggctttctctgggccggctggaccctgctttcgctgtcgctgatctccggctggctgttcgtcgagaacctgttcgcccagcacctggtgcacaagaccctgctggcctgcctggcctgggtggtgttcagcgtgctgctgtggggccgcaaccgcctcggctggcgcggacacaaggcgattcgctggaccctggccggcttctgcctgctgatgctggcgtacttcggcagcaagctggtccgtgaatacatcctgcatatctgacgagcggcgataatggacaacctgcccatagagccgatgctcgtggtcctggccttgctggtgctgtggtcggggctgttcaccgccatcgaagccgcccagcaacacctgctgaccctgcacaccgcttcgcgctccggcgacaaaccgctggcgcgcctgagcttcccgcgcgacagcctgattctctgcaacaccctgtgtcgggtgctggcggtcatcatcagtaccttgctggcgctcctgcagtgggcggaaaacggcccctggctggcctgcctgatcgccaccagcgtgttgctggtactcgccgactacctcccgcgcaccctggccacccgttatccggatgccatcctcagcctgggtaataccctgctgggcgtgccgctgaagatcatctaccccgcggcctggctgctcgacagcatcagccagctgttgctgcgccccttcacccgcaaggccggcgccgtcaggcagagcgaagacgagcaggccgccgacccggacggcgccgaagaacatgccaacggccgtccgcacccggtgtcgggcatccatgccctggacaacatcaccgtcaatgacatcctggtgccgcgcagcgaggtcgacgggatcaacctcgacgaccccatcgccgacatcatcgaacagctgcgcttgtccaagcgcacccgcctgccggtgttccacagcgatatcaaccaggtcgaggcggtcctcaacacccgccagatccgtcacctgctgccggatgccagcctgacccaggaggcgctgctggcggcctgccacgaaccttacttcgtgccggaaagcaccccgctgcagctgcaactgctgaacttccacaagcagcagcgccgcctgggcatggtggtggacgagtacggcgaagtgctgggcatcgtcaccctggaagacatcctcgaagaaatcgtcggcgaattcgaaagcgaacacagcctcgacaacccgcatatccatccccaggccgacggacgtttcgtggtcgaaggcgccgcctcgattcgcgagctgaacaagagcctgggctggcacctgccctgcgacggcccgaaaaccctcaacggcctggtcaccgaagcgctggagaccattcccgacagcgccgtttgcctgaagatcggccgctaccgcctggaaatcctcgaaaccgaggacaaccgggtcagtcgcgtgctgatctggcacaccaaaccgctcaccgcgcccgccctgtagccctgtagccgcttccgagcccgcgaggctgcgatcgaccgcgaagcggtcgcaaaccctgcatccaccttctgcctgacacaccgcgcaggcagactttgcgccggctgcgccgttgatcgcaggctgcgccagcggctacagggcggcaagtcccgcttgtttgatcgttaggggccttcctataatcgatccgcttacccacgccccgcagaacccgcatgctacccgcacccagcggcttctgccctgctccgcccgcttctggcaggcttcgctcccaccccgagccgcgcctgtgccaaacccacatccctgggtgttcgatcataataattcgctcccatggagcacatgactgtcagggataaccgcatgacgaccagcaccacttacagcgcctccgtgcctgcccagccgaccaactccgccagccgcgtggccaccgccagctttatcggcaccgccatcgagttctacgatttctacgtgtatgccaccgccgccgcgctggtgatcggcccggtattcttcccgcagacgtccggcaccgcccagatgctctcggcattcctgaccttcggcattgccttcctcgcccgccccctggggtcggcgctgttcggccacttcggcgaccggatcggccgcaagtcaaccctggtggcatcgctgctgctgatgggcgtgtgcaccacgctgatcggcgtgctgcccggctatgacagcattggcgcctgggcaccgatcctgttgtgcctgctgcgtttcggccagggcctggggctgggcggcgaatggggcggcgccgcgctgctcgccacggaaaacgcgcccaaaggcaaacgcgcctggttcggcatgttcccgcagttgggaccatcgatcggttttctcgcggccaacggcctgttcctgaccctggccatgagcctgagcgacgaacagttccgctcctggggctggcggatcccgttcctgctcagcgccgccctggtgctggtcggcctgtatgtgcgcctgaagctgcatgaaaccccggtattcgccaacgccatcgcccgccaggaacgggtcaagatgccgctggtcgagctgttcagccagtactggctgccggtgctgctgggcgctgcggcgatggtggtgtgctacgcgctgttttatatctcgacggtgttctcgctgagctacggcgtcgcgaccctcggctacagccgcgaaaccttcctcggcctgctgtgcttcgcggtgctgttcatggccgcggccacgccgctgtcggcctgggccagcgaccgctatggacgcaagccggtgctgatcatcggcggcctgctggcgattctctccggcttcaccatggaaccgctgctgacccagggctcgacctggggcgtggcgctgttcctgtgcatcgagctgttcctgatgggcgtgaccttcgccccgatgggcgccctgctgcccgagctgttcccgacccacgtgcgttataccggcgcatcggcggcctataacctgggcggcatcgtcggcgcctcggcggcgccgttcttcgcccagaagctggtggcgatggggggattgagttgggttggcggctatgtgtcggcggcagcggtgctcagcctgatcgctgtgctgtgcctgaaggaaacgcgcaataacgacctggaccaggtcgcctgaaagagtgcttcgcgagcaagctcgctcctacaggttcagcgcaatccttgtaggagcgagcgggcggcgatccgacttgcccgcgatgctttttacagttctacaacgaccgcctgggaagcgcgggtcgccttggcccgcgcggcctcgatcgactcgtcgcgtgccagggccacgcccatgcggcgctgaccgttgacttcaggcttgccgaacaggcgcagggccgtatccggctcgctcagggccgcgcccaggttggcgaaagcggtctgggtcgactggccttccaccaggatcaccgccgaagccgacgggccgaactgacggatcaacgggatcggcaggccgagaatcgcccgcgcatgcagggcgaactgcgacaggtcctgggaaatcagggtcaccaggccggtgtcatggggacgcggcgacacttcgctgaaccagacctggtcgcccttgatgaacagctcgacgccgaacaggccacggcctcccagggcctcggtcacggccttggccacgcgctcggactcggccagggctttcgggctcatggcctggggctgccaggactcctgataatcgcccttctcctgacggtggccgaccggcgcacagaaggtggtgccgccgacatggcgcacggtcagcagggtgatttcgtaatcgaaatcgatgaaaccttcgatgatcacccggcccttgccggcacgcccgccttcctgggcgtagtcccaggccttctgcacatcgtcgacgctgcgcagcaggctctggcccttgcccgaggaactcatcaccggcttgaccacgcaagggaagcccaggtcgtccaccgccttgcggtagtcttcgaaggtgtcggcgaagtggtagggcgaagtcggcaggtccagttcttcggcggccaggcgacggatgccttcacggttcatggtcaactgggcggcccgggcggtcgggatcacggtgaacccttcggattccagctccaccagggtggcggtggcgatagcttcgatctccggcacgatgaagtgcggcttctccgcctcgatcactgcgcgcagcgcggcgccgtcgagcatgttgatcacatggctgcgatgggcgacctgcatcgccggcgcattggcgtagcgatccacggcaatcacctcaacgcccaggcgttgcagctcgatcaccacttccttgcccaactcaccacagccacacagcaaaacgcgggtcgcggttggcgacaatggagttccgatacgggtcatctgaaggtcctcaaaaaggagcggatcatcgagggtcgcgcaccaggcgggcggcccatggggaagaaagcgcggcattttacatgaaccgcgcgctttggcctcagccggcgcacgccgccttgcgcaaacgccaggccatggccagccagaccacggtcacgccggcgaacttagaacccagcgcggtgaggatcacgcccggggtcaatgcatcgatcagtccgaaaaagataaaggtgtccaggggaatgctcaacgccgaacttatccacaggcggtcgtgcaatgggcgcttggtgatgctgaacaccagccagtcgatgcactcggagaccgcgaacgccgtggcgctggccagggcgatggccgggtcggaggtcacgtaggacagtaccagcgccaccagcatggcgacgagcgcgccatgaccgaagcgggtttgcaccatgtcccgcaggacgaacaccagcccgccccaggccgaccagatgatgtccaggtgcggagcggtagaaaaagcgtagttgatcagcacgacactgccgatataggcgatcaggaagagcatggggcgaaaagtacctgtcagtaaggcgcacagggtacttcaggcgggtgggatgggccagacgatagccgtctagccgggctgggtgccgatcatccacagcagcccgctggacttggcgcgctcatgacacagcgccagcacttcgcggcgctcggcgttgtccatgcggctccagcgggtgatctcgctcaccgtgcgctggcaaccgatgcagatatcgtcatcgtccagcgcacagatgctcacgcagggcgaacggacgggtttttcgggttcgctcattgttcttgctcggccagatcgcgggcgtaacgctgggaattatgcacatagtgcgcggcgctggcctcgagcatcttcttctgctgctcggtcagttcacggaccaccttgcccggcgagcccatcaccagcgaaccgtcggggatctccttgccttcgccgatcagcgagttggcgccgatgatgcagttcttgccgatcttcgcgccgttgagaatcaccgcgttgatgccaatcaggctgtagtcgccgacggtgcagccatgcagcatggcgttgtggccaatggtcacgccggtgccgatggtcagcggaaagcccatgtcggtgtgcatcaccgtgccgtcctgcacgttactgttcctgccgatcaggatcagctcgttgtcgccacgcagcaccgcgttgaaccagacgttggccccctcctccagcttgaccttgcccaccagcgtggcattgggtgcgacccagctttgcgggtgggtttcgacacgggcgtcgcccaggcggtatttcatatttattgtcctcaaggccaggcaggttcacgtatacagcagggttcaggccatacgagcgatggcttcaaatattgataaagcttttgggcggctggtgcaggctgatctgggcgtcatacagcaggttgatcagctcgacgatcatgatcgccgtcaggccccagatcttgtactcgccgaagcggtagctcggcacgtaccagctgcggccctgataatcgatgcggtgagtatgctcgcgcgggtcctggcggaaaaactccagcggcacgctgaacaccgcggcgatctcggcgtcattggccaggtactcgacgtaatcgggaatcaccccgacatagggcgtgaccttgatcccgtgcagggaaatcagcgggctcagggggccgatcacttccaccagccctggaggcagaccgatttcctcttcggcttcgcgcagggcggtaaaaatcaggtcgggatcttccgggtcgcggcggccgccggggaacgccacttcgccgccgtgggtggacaatcctttggcgcgcagggtcagcaccagctcaggctcgtcactgcgggtaatgggcaccagcacggcggcctcggggaaacgtcgatccgtctccagcggtcgcggcgtatggttgcttacccggtgcagtagctcgtccagcatgagtcttctcgatctgtcgactaccttgcatcatgcaccaaacaaaccgaccgcccaagccccgatccacgccatgtcgcgtaacgacaacttgccgacaaagccccgtgcacgccaagataggcgcagccttttcggatacccagcatgaaattctgcagccagtgcggtcacccggtcacccagcgcattcccgaaggcgattcgcgcctgcgttttgtctgcgacaactgccagaccatccattaccagaacccgaacatagtcgccggctgcctgccgacctggggtacccaggtgctgctgtgccgacgcgcgatcgagccgcgtcgtggttactggacgctgccggccggtttcatggagaacggcgagaccgtcgaacaggcggcgattcgcgagacgttcgaggaggcctgcgcccgggtccgcaacctgagcatctataccctgatcgacgtcccgcacatcagccaggtgcatgtcttcttccgcgccgaactggcggacctggatttcgccgccggcgaagagagcctggaagtccggcttttcgaagaagccgacatcccctggtccgagctggcttttcgcacagtcgggcgtaccttagaatgtttcttcgctgaccggcggaacgaggactaccccgtgcgttccgagtccattctgcccctggctcagcctgccctcacttaaacaacaaaacgtacgcggcacctgtgtactcttagggatatcgtttcatgcgctggttgctcgctcttttctgctactcggttatcgcggtctcccacgcctccgcgacggataccctgaacggcaaggtcattgaaaaagtcctggtcctcaagtcggcccatcagttgcaactgatcaacgacggcaaacccatcaagacctaccgtatttccctgggtaaacgacccaaggggccgaagctcatggaaggcgacaagcgcactccggaaggcttctactggctggactggcgcaagaccagcgaccgcttcaacctggccatgcatatctcctacccgaacatcagcgattccgcccgctcacgccgcgagggcgtggagcccggcggcatgatcatgatccacggcactccggacagcgaagactaccccgagcagtacttccataccctggactggaccgacggctgcatcgccatgcgcaacgtcgacatgcgcgaagtctggggcctggtcccggacggcacgatgatcgaaatccgcccctgattcctcgctgaaacgccgctaaaacacctcagttacaaaaaaatcgcaggccgcgccggcttcgaaaggtgaataccaattcccgctcgaaaaaccgccgcccctgcgattttcgcattcatggccagaccgccctaataccacttcaccaccccatccccgccaacgcccataaagcgcctgttttcgtgcgtcatcgtcacactaccggcgttgacatggtatttaagtggtattagtttttgccacattaccgggcgacaacaaaccaataacgcatcggaatctcgacagatgaaccacatcctggccctgcgccctgacgatacccagccgaccccgctgtacctgcaactggcgcgcaaccttgaagccgcgatccatgccggccagtggaaagccgaacaggccctgccctcggaacgcaacctgagcgagatgctcaatatctcccgcgtcaccgcgcgcaaggccctggaagtgctgttcgaacaaggcctgatccgccgcagccagggctccggcaccttcattaccccgcgcctggaacaaccgctgtcgcggctgtcgggcttcagcgaaatgctccgcctcaagggcttcgtgcccggctcccaatggctggagcgggaaatcaccacgccgacccacgaagaactgatccgcctcggcctgtcgccgaacgacaaggtggcgcgcctcaagcgcctgcgcaaagccgacgacacggtgatggcgatcgaaatgagcaccctgccggccacgatcattgcccagccggacgccgtgggcgactcgctctacgcctacctcgatggcatcggccgcccggtggtccgcgccctgcagcatatccaggcgatcaacgcctccgccgagttcgccgccctggtgggcatcgcccccggcaccgcgatgctgctgatgacccgtgtcggctacctcgaggacaacaccccgatcgaagtcaccgacacctattgccgcaacgactactacgacttcgtcgccgagctacgtcgctaaaccaggccgccgagccaggccgccgagtcgccaagaacccgtcccagagagctgcccatgtccgaacacaacatcctcaccccacaaggctggattcgcggccgcctgaaccaccgggacggcaaggtcaccggcatcgaaggcagcccctgcgacccggcggacaacgacctgccctacctgctgccgggcttcatcgacctgcatgtgcacggcggcggcggcaaggacatcatggaaggcgccccggcgttcgagaccatcacccgcacccacgtgcgttttggcaccacctcgctgctggccaccaccatgaccgcaccgaccgaggagatcacccgggtcctgggcgccatgggcgaatactgcgaacagcgccccagcggcagcgcccgggtactcggtgtgcatctggagggcccgtacatcaacccgggcaagctcggtgcccagcccaatttcgcccacaccgcactgatggccgaagtcgaggcgtacctgcgcctggcgccgatccgggtgatcaccatcgccccggaaatcgccggccatgacgcgctgatccgcgccctcagcgcccgcggcatccgcatgcagatcggccacaccctgggcagctacgaggaaggcgtggccgcgctcgacgccggggccaccagcttcacccacctgtacaacgccatgagcccgctgcatcaccgtgagccgggcatagtcggcgccgccctggcccacgcccagtacgcggaactgatccccgacctgctgcacgtgcaccctggcgccatgcgcgtggccctgcgctcgatcccctgcctgtactgcgtgaccgactccaccgcggcggccggcatgccggatggcgaatacaagctcggcagccacaccgtgaccaaatgcctgggcggcgtgcgcctgccggacggcaccctggccggcagcaccctgaccatggaccaggccttgcgcaacctggtgaagatcggcctgcccctggccgaggcttcgcaacgcttgtcacagtttcccgccgattatctcggtctggccgaacgcgggcgtttgcagatcggcagctgggccgactgcgtgtgcctggaccgctcactcacactgaccgccgtgatggtcgaaggagaagacattgacttcaaaaatgcttgaagaggcgctgtccgccgccacggccgtcgaaggccagttgcagcacctggacccgcaactgatcgaagtcgccgggcgcctgaaccgccagccgccgcaagtggtgatgaccgtcgcccgcggcagctccgaccatgccgccagctatttcgcctacctgaccatgcagcagctgggtttcccggtcgcgtccctgccgatgtcggtggtgaccatgcaacaggcgccgctgcgggtcagcggccaggcggcattcgccttttcccagtccgggcagagccccgacctggtcaacagcatgcgcctgctgcgcaaacgcggggccttgagcgtggccatggtcaacgcccaggacaccccgctggaagccgccagcgagttctgcctgccgctgcacgccggcgccgaacgcagcgtggcggcgaccaagagctttatcgccaccctcagcgccagcgcccgcctgatcgcccactggaaacaggacgcgcagttgctggaagccggcctcgccctgccccagggcctgcgcgaagccgcgacccaggactggagcccggccgtcgaggccttgcgcgatagccaacggttgatggtgatcggccgtggcgccggtttcgccatcgcccaggaagcggcgctgaaactcaaggaaacctcggcgatccaggccgaagccttcagcagcgcggaagttcgccacggcccgatggcgctgatcggcgataactacccgctgctggtgttcgccccacggggagcggagcaagccggcctgatcagccttgccgccgacatgcgccagcgtggtgcccgggtgctgctggcggcgccggacgacatcgtcgaacgcgacctgaccctgagccgggccgaacacccggccctcgatccgatcctggcgatccagagtttctacggcatggccgcaagccttgccgaggcccggggcatggacccggaccagccacggcacctgagcaaagtgacccgcacccactgagcctttccttcaacggatgagtactgcgccatgcacaacaacaataaagacctgacgctcggcgctcccttgagcggcccggtgctcacccttgccagagtgcccgacctggtgttttccagcggcgccatgggcgacgggatcgccatcgacccgctgaacaacaccctgcatgccccctgcgccggcgtggtggtacatgccgcccgcaccggccacgcggtgaccctgcgcgccgacaatggcgcggaactgctgctgcacctcggcctggacaccgtccagctgcaaggcgagggtttctccatgctggtgcaggaaggcgcccgggtcagcagcggccaggccctgctgcgcttcgatctcgaccaggtcgcgcgcaacagcaaaagcctgatcagcctgatgatcctgaccaacggcgaacacttccagaccctgcccatcaccctgaaatcggtgaaagtcggcgaaccgctgctgcacatcgttccacgcgcggccaacacgacccaggcggaagcaggcgacacctcgaccgacgaggtggaaggccagacccgggtcaatcatcgcggtggcctgcatgcccggccggccgcgctgatacgccagaccgcccagggcttcagcagcaaggcgcacctgcatttcaacggcaagtcggcgtcctgcgacagcctggtcagcctgatggggctgggggtcggcgagcaggacgaggtgcgggtcagttgccagggcaaggactgcaaggccgccctgctggcgctgctggacgccctcgccaccccgctggccgaagacgcccacgccgcggcgccagcggtgaaggccgtcgcgcgccagcgccccgccgaagccggggtgatccagggcgtttgcgccgctcccgggctggtctgcgggccgctgtttcagctgaccgccatgaccctgccggaagacagcggcggtcacctgtcccaggaacaactgcaggcgctggacctggccctggacaaggttcgcagcgacattcgcggcaccctggagcacgcccggcaacgcaaggacaaccaggaagaagcgatcttcgccgcccatctggccctgctcgaagacccggcgctgctggacgccgcccgccagagcatcggccagggacgcgtcgccacccacgcctggagcgacgccatcggcgaacagtgcgagatcctgctgcaactgggcaatgccctgctcgccgaacgcgccaacgacctgcgtgacctgcaacagcgggtcctgcgcgccctgctcggcgaggcctggcattaccagttgccggccggcgccatagtcgcggcccacgaactgaccccgtccgacctgctgcaactgagcgagcaaggcgccgccggcctgtgcatggcggccggcggcgccacctcccacgtggcgatcctggcccggggcaagggcctgccctgcctggtggccctgggctcggagcttctcgatgtgccgcaaggccagcaggtggtgctgaacgccgatcacgggcgcctggaactgacgccggacagcgcgcgcgtcgaacaggtccggcagagccatctgctccgccagcaacgccgcgaacaacaacagcaacaggcccaactaccggccaggaccctcgacggccaggcgatcgaggtcgccgccaatgtcgcctccagccaggaagcccagggcgcccatgccaacggtgccgatggcgtcggcctgctgcgtaccgagtttctgtttgtcgaccggcataccgcccccgacgaacaggaacaacgccaggcttatcaggccgtgctcgacgccatgggcgacaagtcggtgatcatccgcaccatagacgtcggtggcgacaagcaactggactacctgccgctgccggtggaagccaacccggtgctgggcctgcgcggcatccgcctggcccaggcccgcccggaactgctcgaccagcaattgcgggccctgctgcaggtcagcccgctgcaacgctgccgcatcctgctgccgatggtcagcgagctcgacgaactgctgcatatccgcgaacgcatcgattgcctgtgcgccgagctgggaatcggccagcgcccggagctgggggtgatgatcgaagtcccggccgccgccctgctcgccgagcaactggccgaatacgccgacttcctctccatcggcaccaacgatctgtcgcaatacaccctggccatggaccgtgaccatgccggcctggccgcccgggtcgatgcgctgcacccggcgctgctgcggctgatcgcccagacctgcgccggcgcggccaggcatgggcgctgggtcggcgtgtgcggcgcactggcctccgacccgctggcgacgccggtgctgatcggcctggggatcagcgagctgtcggtgagcccaccgcaagtgggcgaaatcaaggagcgggtccgccaactggacgctgcgcaatgccgacgcctcagccacgacctgctgaacctgagcagtgcctcggcggtgcgtcatgcctgccaccaacactggcccctgagctgaataacaagaacaccaggagacacgccatgtaccaattattcatcgaaggcctgcagcgcctgggccgcgccctgatgctgccgatcgcgatcctgccgatcgccggcctgctgctgcgcctgggcgacaccgacctgctgaacatcgcgatcatccacgatgccggccagaccattttcgccaacctggcgctgatcttcgccatcggcatcgccgtgggcttcgccaaggataacaacggcaccgccggcctggccggggccatcggctacctggtgatggtcgcgaccctcaaggtgctcgatgccagtatcaacatgggcatgctcgccgggatcatcagcggcctgctggccggtgccctgtacaaccgcttcaaggacatcaagctgccggaatacctggcgttcttcggcgggcggcgcttcgtgccgatcgtcaccggtttcagcgccgtcggcctgggggtggtgttcggcctgatctggccgccgatccagcacggcatcaacagcttcggccagttgctgatggaaagcggcagcctcggcgccttcgttttcggcgtgttcaaccgcctgctgatcatcaccggtctgcaccacatcctgaacaacatggcctggttcattttcggcagctttaccgacccggccaccggcgccgtggtcaccggcgacctgacccgctacttcgccggcgaccccaagggcggccagttcatgaccggcatgttcccgatgatgctgttcggcctgccggcggcgtgcctggccatgtaccgcaatgcgctgccggagcggcgcaaggtgatgggcgggattttcctgtcgatggccctgacctcgttcctcaccggggtcaccgagccgatcgaattcgccttcatgttcctcgcccccatgctgtacctggtgcacgcgctgctgaccggcctgtccatggccctgaccaacctgttgaacatccacttgggcttcaccttttccggcggcgccatcgacatggcccttggctggggtcgctccaccaacggctggctggtgttcccggtaggcctgctgtacgcggtgatctactacctggtgttcgacttctgcatcaaacgcttcaacctgaaaaccccgggccgcgaagacaccccgggcaccgaaaaagccgccatgaccaacaatcagcgcgccggtgcctatatccaggccctgggcggcgcggacaacctgataaccgtcggtgcctgcaccacccgcctgcgcctggagctggccgaccgcagcaaggcgtcggacagcgacctcaaggcccttggcgccatggccgtggtgcgtcccggcaagggcggcagcctgcaggtggtggtcggtccgctggccgacagcatcgccgatgaaattcgcctggccatgcccagcgccggcaagccactggaacagccaggccccgccgccgcggccttcgaagcaccgccagcggagagcatcgcgccccaggaagccgtgaaatggctggacgccttcggcggcagcgacaatgtgctgcaactggactgcgtggccatgacccgcctgcgggtgcaactgggcgacaacaaggcactgtcggaatgccagctgaagagccttggctgccagggctcaagccagctcgacaatggcgtctggcacctgctgatcggggaaaaggccgcgagcctgggccaggcgctggatagcctgatcaaccgcagcgaggtcagcgccaaggtctgaccctctcctgccggagagcaggcacaaaaaagcccgctgaccgttatcggttcagcgggctttttcatgggcggggccttagaagtcttccagacgccagacttcataagccggtgtctcgtagggatggctctgcttgagggccatcaccacgctacggatcaactcgtcggccaccaccagctcgactttccattcctgcacctgctcgaccaggccggtctgcccgagaaacggctggctgccgtccaatgggcgaaactggccctggcccagcacctgccacgcacactggtcgtaagcgccgatccgtccgccaccggcggcgaatacggcgttcttgaccacatccacgtggctgggcgggacgaaaaagctgagcttgtacacgggccttagttcacccacacgcgagcgttacggaacatgcgcatccacgccgcatcttcgttccactcttccggacgccaggagttctgcacggcgcggaatacccgctcagggtgcggcatcatgatggtgacgcggccgtcgcgactggtcaggccggtaatcccgcgcggcgagccgttcgggttggccgggtagctttcggtgaccttgccgtggttgtcgacgaaacgcagggccacgcaaccggacaggtcggcttcaagcagcgcttctgcgctttcgaattccgcatggccttcgccgtgggcgatggcgatcggcatacgcgaaccggccatgccctgcaggaagatcgagttcgactcctggacctggaccatcgccacacgggcctcgaactgctcggagcggttgcgcacgaagtgcggccagaactcgctgcccgggatcaactcgtgcaggttggacatcatctggcaaccgttgcacacgccgagggtgaaggtgtcgttgcgctcgaagaagccctggaaggcgtcgcgggcacggctgttgaacagtgccgacttggcccagccctcgccggcgccgagtacgtcaccgtaggagaagccgccgcaggcgaccatgcccttgaagtcgttcaggtcgacgcgaccggcgaggatgtcgctcatgtgcacgtcgatcgcgttgaagccggcacggtcgaacgccgcggccatttccacctggccgttgacgccctgctcgcgcagcacggcaacctggggacgcacgcctttcttgatgtaaggcgcggcaatgtcctggttgacgtcgaagctcagcttgacgctcaggcccgggttgtcttcttccagcaggacgtcgaactcctgctcggcgcagtcggcgttgtcccgcaggcgctggatctgatagctggtttcagcccactggcgctgcaacaggcgacgctcgccggcgaagatattctcgccattgaaggtgatgttgatatggccgttgttgaccggctggccgatcaccgccacgcagtcgcccaggccagcggcgctgaactgcgccagcacatccggggtcgcgtcctggcgcacctggatcaccgcacccagttcttcgttgaacaggatggcggcgatctcggccgagctctcggccagggcgtcgaggttcaggttcaggccgcagtgaccggcgaaggccatctccaccacgctggtcagcagaccaccgtcggaacggtcgtggtaagccagcaggtgaccgtcggcgttgaggccctggatcaccgcgaagaaggctttcaggtcttcggcgtcatcgacgtccggggcctgcttgccgagcttgccatgcacttgggcgaggatcgaggcgcccatgcggttctggccacgcccgaggtcgatcaggaccagatcggtggtgcccttgtccatgcgcagttgcggggtcagggtctggcggatgtccgccacaggcgcgaaaccggtcacgatcagcgacatcggcgaggtcacggttttttcttcgccgttgtcgttccagcgcgtggccatggacatcgagtccttgcccaccggaatggtgatgcccagctcagggcacagctccatgccaaccgctttcacggtgtcgtacagccgtgcgtcttcgcccgggtggccggcggcggacatccagttcgccgacagtttgatgtcggagatcttgttgatgcgcgacgcggcgatgttggtcagggtttcgccgatggccatgcggcccgacgccggggcgtccagcagcgccagcggagtacgctcgcccatggccatggcttcaccggtgtagacgtcgaaactggtggcggtgacggccacgtcggccaccggaacctgccatgggccgaccatttggtcacgggccaccaggccggtgatggtgcggtcgccgatggtgatcaggaagcttttgctcgcgacggccgggtgatgcaggacgcgctcgatgctttcgccgatgtcgaggttcgacgggtcgaaatcgtcgcccagttcggcttcgcgaaccaccgaacggtgcatgcgcggcgccttgcccagcagcacttccagtggcatgtccaccgggctgttgccgaagtggctgtccgtgacagtcagatgcggttcggcggtggcttcaccgacgacggcaaacgggcaacgctcacgttcgcagatggcctggaagcgctcgaagtcggccgggccgacggccagaacgtagcgttcctgggattcgttgctccagatttcgtgcggggccatgcccggctcgtcgtttggaatgttgcgcagttcgaaacggccaccgcggtcgccgtcgttgaccagttccgggaaggcgttggacagaccgcccgcgccgacgtcgtggatgaagctgatcgggttcttgtcgcccagctgccagcaacggtcgatgacttcctggcaacgacgctccatttccgggttttcacgctgaacggaagcgaaatccagatccgccgagctggtgccggtggccatggaggaagcggcgccgccacccaggccgatgagcatcgccgggccaccgaggacgatcagcttggagccgacgacgatctcgcctttcttgacgtgttcttcgcggatgttgcccatgccgccggccagcatgatcggcttgtggtaaccacgaacctcgtcaccgtgcggggtggcgatcgactgttcgaaggtacggaagtagccggtcagggccggacgaccgaattcgttgttgaacgcggcgccgcccagcgggccttcgatcatgatgtccagcgcggtgacaatgcgctcaggcttgccgtacggcacttcccacggctgttcgaagcccgggatctgcaggttggatacggtgaaaccggtcaggccggcctttggcttggcgccacgcccggttgcaccttcatcgcggatctcgccaccggaaccggtggatgcgcccgggaacggggcgatggcggtcgggtggttgtgagtctcgactttcatcaggatgtgcaccggctcctgcaccgcgccgtactggcgggtttcagggttcgggaagaaacggccggcgacattgccgacgatcaccgaagcgttgtccttgtaagccgacagcacaccttcgttgtgcatctgataggtgttcttgatcatgccgaacaggcttttttcctggctctggccgtcgatgtcccaactggcgttgaagatcttgtgacggcagtgctcggagttggcctgggcgaacatcatcagttcgatgtcatgcgggttgcgcttgaggccctggaaggcgttgaccagataatcgatttcgtcttcggccagggccaggcccagttcggtgttggcctgttccagcgcggcgcggccaccaccgaggatatcgatggcggtcagcggtttcggcgtggcatggctgaacaggccggcagcctgctccaggttgcccaacacgatctgggtcatgcggtcgtgcagagtgtcggcgatcaactgcgcttgcgcgtcgctgaattcaccggccacgtagaaggcaatgccgcgctccaggcgctggatcttgctcaggccacagttacgggcgatatcgctggccttgctcgaccagggcgagatggtgccgaaacgcggcagcaccaggaacagacgaccggtaggttcttgcaccggtacgcttgggccgtacttcagaaggcgcgcaagcacctgctgttcgtcgccggtcaggacgccggtaacttcggcgaagtgagcgaattcagcatacaggccactgacagctggaaccttctggctcagttgctcaaggagtttgctgtggcgaaaggcagaaagggcaggagcgccgcgcaggatcaacatcttcgggacagcctcgggaagggggtgtgctttgaggccgtgcattctagcctaaaccgcccgcgacggcacccgaaacggcacgcccgagcgcggccagacgtcggcccgtgcgcagccccctgtgacaaaggctcgtcaggaccattcagcagggttatttcacccctctccacgggccgcgaaggcccattcccgagggctctggccgggggctggaacctctagcagacaagcccttcgctgtcgagatatggcggttgttgtcctttgcgtatactgcgcagatgttttcccctatggctttacgtccgcgctgtgcccgatggctcatcgcaaccggactcttcctgatgctcagtgcctgcgttgagaaacccagcacgctcgagcgagtaaaggaggatggcgtgctgcgggtggtcacccgtaacagcccggccacctacttccaggatcgcaacggtgaaaccggcttcgaatacgagctggtgaaacgtttcgccgacgacctgggggtgacgctgaagatcgaaaccgcggacaacctcgacgacctcttcgaccagctgggtaaacctaacggcccggtgctggctgctgccggtctggtcagcagcgagaaacgcaagcagcaagtccggttttcccacacctatctggaagtcaccccgcagatcatctaccgcaacggccagtcccgccccaccgatgcgggcgatctggtcggcaagaagatcatggtgctcaagggcagcacccacgccgagcaactggccgaactcaagctgaaataccccggcattcaatacgaagagtccgacgaggtcgaagtggtcgacctgctgcgcatggtcgacgaagggcagatcgacctgaccctggtggattccaacgaagtggcgatgaaccaggtgtatttcgccaatatccgcgtggccttcgaccttggcgatgcccgcaaccagagctgggccgtggccgccggcgaagacaatagcctgctcaacgaaatcaacgccttcctcgacaaggtgcagaagaacggcaccctgcagcgcctgaaagaccgttattacgggcatgtggacgtcctgggttatgtcggcgcctacacctttgcccagcacctgcaacagcgcctgcccaaatacgagaagcacttcaaggcctcggccaaggaagaaaaggtcgactggcgcctgctggcggccatcggctaccaggaatccttgtggcaaccgagcgttacctccaagaccggcgtacgcggcctgatgatgctgacccagaacaccgcccaggccatgggcgtgtccaaccgcctggacgccaggcaaagcatccagggcggcgccaagtacctggcgtacatgaaggatcaactggacgacaagatcgaagagccggaccgcacctggttcgccctcgccgcctataacgtcggcagcggccacctggacgacgcccgcaagctggcgcaaaaggaagggctgaacccgaacaagtggctggacgtgaagaagatgctgccgcgtctctcgcagaagcagtggtacagcaagacccgctatggctacgcccggggtggcgagccggtgcattttgtcgccaacatccgtcgctactacgacatcctgacctgggttacgcagccgcagctggaaggcgaccaagtggccgagggcaacctgcacgtgccgggcgtggacaagaccaagcccacccaggaaaccccgccgctttaaagcatctgtagccgctgccgcaggctgcgatcgaccggaggtcgtggcgattccaagaacgccgaagctccttcggagcttgtcgcagcctgcggcagcggctacagagtttccgtcaggccttggccgccgccaggatcaacgccttcatctccgccactgcgcctttgaagccgacgaacagcgcatgggccaccagcgcatggccgatgttcaactcgttgatgcccttgatcgccgcgaccgcctcgacgttgtggtaatgcaggccgtggccggcattgacgatcaggccctggcccaggccgaaagccacgccgtcggccacgcgccgcagttcctcggccacctcgctcggcgtttcggcatcggcataacgcccggtgtgcagctcgatggcgggcgcgcccacgcggcgagaggcagcgatctgccgctcatcggcgtcgatgaacagcgacacttcggcaccgatcttcgacagccgctctaccgccgccttgatccgcgcttcctgcccggcgacatccaggccaccttcggtggtcagctcctggcgggtttccggaaccaggcagatgtgcgccggacggatgcgctcggcgaacgccatcatttccttggtgacgcccatctcgaagttcatgcgggtttgcagcacgtccttgagcagcagcacgtcgcgctcctggatgtgccggcggtcctcgcgcaggtgcacggtgatgccgtcggcccccgcctcttccgcgtccagcgccgccttgaccggatcagggtaacgggtgccccgggcctgacgcagggtggctacgtggtcgatgttcacgccaagaagaatgcgattgctggtggtcacggaagcgctcctgaggagttagagattcggtgcacagcatatagtgtccgcccgcgaaaataactgccggctttcggtcgcacgagcaagccaggcaggattcgagcgtattggcgcaacgggaagactagggcttgcgaaacaactcgcgactgaccaggggccggccgcccaggtgcaccgccagcgcctggcgcatcaggcgcttggccgccgccagcgcgccgggggcgctccagtcggcttgtgccatggccagcagctcggtgccgttgaacaggcctggttgcaacaggtgaacctgctccagaccggcatccacctgcaggcggtacatgccctgcgcctcaatcggcgcgccgtggatatccatgtccagggcgaagccgtagcccaggtcgtccagcaggcgccactcgaacgcgcgcagcaagggctcaagggccctgccctcggccaaagccagcaaggttgccgcatagtgctcgaagatcgctggatgcgggtcttcggcaggcagcaggcggatcagcagctcattgaggtaaagaccactgaacagcgcttcgccgttgagccaggtggaggttcccgcgctttccatgcgcccgacgtttttcagctcgccgcgcccacgaaattcgacttccagcggcacgaacggccgcgccagggtcccggccttgccccgcgcgccgcgcaacaccgcgcgcagccgcccctggggcgtgaggaagtccaccaatgcactgctctcgcgataggcgcgactgtgcaggacataagcgggctggccgatgggagcgttactggacataggtgtcggggggatctcaaggcttgagaaagtgacaggtccacgggaaggttcgttgaacctttatcgccagcggctcgctccctacacgttgcaggaacgaggcgccggcgacggggcaggattacaggtcgccgtagcccagcgaacgcagggcgcgctcgtcgtcggaccaaccgcctttgaccttgacccacaggttgagcatgaccttggagtcgaacagcagctccatgtccttgcgcgcttccatgccgatgcgcttgatgcgctcacccttgtcgccaatgatgattttcttctggccgtcgcgttcgacgaggatcaaggcatgaatgtgcagggtcttgccctgctgcttgaactcttcgatttccacggtgatctggtacggcagctcggcacccagctggcgcatgatcttctcgcgcaccagttcggcggcgaggaaacggctgctgcggtcggtgatctggtcttccgggaagaagtgatcgttttccggcaggtgcttggcaatcaggccttccagggcttccaggttgtgtccctgctgggccgataccgggacgatctcggcattcggcaattgctcctgcaaccaggtcaggtgcggcatcagctcggccttgtcctcgatgcggtcggtcttgttgatcgccaggatcaccgggccctgcacgtactgcacgcgctccagcaccagctggtcttcatcggtccacttggtgcggtcgacgacgaaaatcaccacatcgacgtctttcaaggccgccgaggcggtcttgttcatgtagcggttcagcgccttctcgttgctcttgtgcatgcccggggtgtcgacgtagatcgcctggatggcgccttcggtcttgatgccgagcatgttgtggcgagtggtctgcggcttgcgcgaggtgatggccagcttctgccccaggatatggttcagcagcgtggacttgcccacgttcggacggccgacgatggcgacatagccacagcgtgttgcggttgtatcagtcatggccattctccacgcccagggcaatcagtgctgcggcggccgctacctgctcggcaatgcgacggctcacaccctgacctcggcttttttcgttcagtagggtgatttcacattcgacgaagaacgtccggcaatggggctcaccctggatatccaccacttcgtagcggggcagttcacaggcacgcgactgcaggaattcctgcaggcgggtcttggggtccttgttggtgtcgaccagcgtcaggctgtcgaactcggacgtcagccaggacagcacgcgctcgcgcgcgacctccatgccggcatccaggtagatcgcaccaatcagcgcttccagggcatcggcgaggatcgactcacggcggaagccgccgcttttcaactcaccggagcccaggcgcaggtattcgcccagatcgaaaccacgggccagtacggccagggtttcccccttcaccaggcgcgcgcgcagacgcgacagctggccttcgcgagcctggggaaaacgctcgaacagcgcttcgccggcgacgaagttgagaatggcatcaccgaggaattccaggcgttcgttgttgcgcccggcaaaactgcggtgagtgagggccaggaccatcagttcctggtccttgaaggtgtaaccgagctgacgctcgagacggctcaaagaaacgctcacggtttacccacgctgagttcgtggttgaatttcaccaccttggagacaaggcacgaggtgcctgtggcaattaacgctgtgttcaaatccacatcctgaatatcgttgactgctgcttctggtgacgcctgggaggctgccgaacctggcgggccggtgttctacaagatccagaaaagcattcggcgctgtgttcaacagcgccgtgtttgattacttgatcaggccaacccgcgagaaattcggcaggtggctgagtttcggttcgggccagctcatccagactgcgaaggccttgccgacgatattcttgtcgggaaccatgcccagcaggtccctgggaatgcttgggtcatcccagtagcggctgtcgttcgagttgtcgcggttgtcgcccatcatgaagtagtgcccggcaggcacggtccattgacgatccggggtggcccggtagcggctcatttccttgcggatcaggtgctcggcggcgccgagtttttccttgtagagctccgcgctgcccagggtacccggctcggagccgaccagttgctcggcgaccgactggccgttgaccagcaggcgcttgtcgctggtgtagcgcacttcgtcgcccggcaggccgaccacacgcttgatgtagttgacgttcggatcgctcgggtagcggaacaccatcacatcgccgcgctgcggatcaccgacctcgatgattttcttgtcgatcaccggcaggcggatcccgtaagaaaacttgttcaccaggatgaagtcgcccacatccagggtcggtttcatcgatcccgaaggaatctgaaacggttccaccagaaacgaacgcagcaccagcacgatgaacagcaccggaaagaacgatttgccgtactcgaccagcatcggctccttgttcagtttctcgatgaccagtccatccggctggctgacgctgccctgatagttggtaatggcggcacgccgacgcggcgccagaaagaccagatcgagcaacgccaacagaccgcagacggcgacggcgatgaccagcaacagcgggaaatttagcgacataggacctaactatccaacctgagcacagcaaggaaggcttcttgtggaatctccacgttacccacttgcttcatgcgtttcttaccggccttctgcttttccaacagcttgcgcttacggctaacgtcaccaccgtagcatttggccagtacgttctttctgagcgccttgacggttgtccgcgccacaatctgcccaccaatggcggcctggattgccacgtcgaacatctgccgaggaatcagttccttcatcttttcggtcaacgcacgccctttgtagtgcgcgttgtcacggtgcacgatcaatgccagggcgtcgaccttctcaccgttgatcagcacatccagcttgaccagattagccgattggtagcgatcgaaatgataatccagcgaagcatagccacgactggtggatttgaggcggtcgaagaagtccaggaccacttcgttcatcggcaggtcgtaggtcacctggacctggctgccgaggaacagcatgtcgtgctgtatgccgcgcttctcgatgcacagggtaatgacgttacccaggtgctcctgcggcaccaggatattggcccgcacgatcggctcgcgcatgtcttcgatggacgacagatccggcaacttcgacgggttatcgacgtagatcgtctcaccattcttcagttgcagttcgaaaatcaccgtcggcgccgtggtgatcaggtccaggtcgtattcgcgctccaggcgctcctggatgatttccatgtgcagcatgccgaggaagccgcaacggaagccgaagcccagtgcgtcggagctttccggggtgtattgcagcgacgagtcgttcagcgtgagcttttgcagggcttcgcggaagtcttcgaagtcgtcggagctgaccgggaacaggccggcgtagacctgcggctgaatgcgcttgaagccaggcagcacttcgacgtcgggggtcgagctcagggtcagggtgtcacctaccggcgcaccgtgaatgtccttgataccagcgatgataaagcctacttcaccggccttcaggtcggtggtggcggtgtgtttcggattgaatacaccgacgctgtccaccaggtggatcttgccggtggatttcaccaggatcttgtcgcccttcttcacgcggccatggcgcacgcgaaccagggacacgacgcccaggtagttgtcgaaccaggagtcgatgatcaacgcttgcagcggatcctcgatgttgccggtcggcgcgggaatggtggtgaccaggcgctccagcacctcgtcgacacccaggccggtcttggcactgcaggtcacggcgtcggtggcatcgataccgatgatcttctcgatctcttccttgacccggtccggatcggcctgtggcaggtcgatcttgttcagcaccggcatgacctccaggccctgctcgatggcggtgtagcagttggcgaccgactgcgcttccacgccctggccggcgtcgaccaccagcaaggcgccttcacaggccgccagcgaccggctgacttcataggtgaagtccacgtggcccggggtgtcgatgaagttcagctggtaggtgatgccgtcgcgggctttgtaatagagggtaacgctgtgggccttgatggtgatcccgcgttcccgctcaagatccatggagtccagaacctgggcttccatttcgcgctcggccaggccgccgcacatctggatgaagcgatcggccagagtcgacttgccatggtcaatgtgggcgatgatggagaaattgcggatatgactcaaatcactcacggatcaacactcaaaaaggctgcaggcatagcccgccgaaaaatagccgggaattgtacctgatagacgacgcaagcgtcacgttcgcctgtcagtggtgcataaacgcaaaacgccccggtctttcgacaggggcgttttgcgtaagactggcgtcattggcgccggtcagccggcccggcgcaacagccagaccccggccagtgcacagaaaccggcgggaaccagcaccgcgaacagcggcgagaagccgaataccaggctcgatgggccgagcaggtcctgggcaatgcggaaggtgaaccccaccagcacgccggtgaacacccgctggccgagcgtcacggaacgcagcggaccgaaaatgaacgagatcgccatcaataccagggccgcggtgaccagcggttgcagcaccttgacccagaacgccagccagtagcgaccgttgttcaggccctggtcggccaggtaatggatatacccccacagaccgctgatcgacagcgactccggcgccatcaccacagtactcagcaattgcgggctcaaggccacgtcccaacgttcctgcgggacgttgatgacttcggtgctgccctcgcggaaataggtggtggtgacgtcgctcagctgccagtagttttcttcgaaacgagcctggcgagcgaagctcgaggacagcatgtgccgctgatcgtcgaagtgataacgggtcacgccatacagcaggccgttgggctgcacagcgttgatgtggatgaactcctcaccctggcggtgccacaggccatgcttggaactttgcgcatcgcccgaaccctgggccagcgcgcgactggcctgcgcctggctttccgtggcaggagcgacgtactcgccgatcagcacacccgccaccatcaggaacagcatcggcttcatcaccgcccagacgatccgcccgatggacacgccagcggcccgcatgatggtcagctcgctattgctggccaggctgcccaggccgatcaggcagccgatcagggccgccatcggcagcatttcataaagccggcgaggcgccgtcaacgcgacaaaactcagcacgtccatcacggtgtagctatcgctgacgctgcccatctcgtcgatgaaggcaaacagcgacgccaggccgagaatgatccccagtaccgccaggatggccagcaggacactgttaccgatgtagcgatcgagcttaaccacgagccacctccttcatgctgcggcggctcgccagtttcagacgcaagggttcccagtacagcaacccgaggccaatcaatagaaacagtccgtgtacccaccacaggcccagcgcctgcggcagcttgcctttttccagcgagccgcgggccgcgatcaggatggtcaggtaagccatataaagaagaatcgccggcaatagcttgaggaaacggccctggcgcgggttgacccgggacagcggcaccgccatcaaggtcacgacaaacaccagaagcggcagggaaatacgccattgcagctcggcatgggcgcgcagatccggattgccgatcaggtcgcgggtcggcatggcgtcgcggtcggtaacttcgtcgctgacatccggcttggccagcaatacgccgtaggtgtcgtatttgatgacccggtaatcggcctggcccgggttgccgtcgtagcggtagccgttttcgaggatcaggtagcggttgccgtccggacgaacgtcctggtgccccttctccgccaccagcaccgagatgccctggtccttcttgtcctggctcaggcgtttttccgaaatgaacacgccaccgaggttggtccggtcatcggacaactgctcggtgtaggtcacccgcgtgccgtcgttgagggcctggaaacggcctggcaccagggtatcgaattcggtcagagcatcctgcttgttgaggatcagttggaactggttggcgccctgaggcgccaggctcaggctcagccaggccacgatcaatgcaaccagggtcgccggaatcatggtcatgcccagcaggcgctgctggctcatgccggtggccgaaagcacagtcatttcgctttcgaggtacagccgaccataggccagcagaatgccgaggaacagccccaggggcaggatcaattgcaggaagcccggcatgcggacccccatgatcaggaacagcgaacccgggtccagtgcgcccgaggccgcttgcgcgaggtatttgacgaaacgtccgctcatgatgatgaccagcagtacagcgctcacggcgctcagggtcagcaacacttcgcgggatagataacggaagacgatcaaaccagacactccagggttgtcaggctaaggcggccaaacaagcaaacacggcccgtgaagccgagccgccgaaaaagatggcgcattatcctgtgattgcatgcgcctgtcactgcgcatactcacgcaggcctctaaagcggcgaagttcgctcatgggagggttgtcagcctcgaccgcccgggttcaaactggcggccctgtcgttggccgctgccgacgcctcttccttataaaagctacagacataacaagcctggcgcacggcattggccctgcgctctttgaccattaattcagggacccggacatggaactggttgtaaaaagcgttagcccggaaacgttaaagaccgccaccctggtggtcgccgtcggcgaaggccgcaagctcggcagcgttgccaaacaactcgacgagctcagtggcggcgccatcggcgcggtactcaagcgcggcgacctggacggcaaggtcggccagagcctgctgttgcacgccctgccgaacctgaaggccgaacgtgtcctgctggtcggtaccggcaaggacgccgaactgggcgaccgcccgttccgcaagatcgtcagtggcatcctcaataccctcaagggcctgggcggcagcgatgccgtgctggcgctggacgaagtggtggtcaagggccgcgacagctacggcaagacccgcctgctggcggaaaccctggtggacggcgaatacagcttcgaccagttcaagagccagaaagccgaaccgcgcgccctgaagaaaatcaccctgctgaccatcaaggccgcgcaggccgaagtcgagcgcgccgcggcccacgccaaggcgatcgccaacggcatggcattcacccgcaacctgggcaacctgccgccgaacatctgccacccgaccttcctcggcgaacaggccaaggccctgggcaaggaattcaaggccctgaaagtcgaagtcttcgacgagaagaagatcaaggacctgggcatgggctcgttctatgccgtgggccagggcagcgcccagccgccgcgcctgatcgtcatgcaatacaacggcggcaagaagtccgagaagccgtacaccctggtcggcaagggcatcaccttcgacaccggcggcatcagcctcaagcctggcgccggcatggatgaaatgaagtacgacatgggtggcgccgccagcgtgttcggcaccctgcgcgccgtgctggaactcaagctgccgatcaacctggtgtgcatcctggcctgcgccgagaacatgccgagcggcaccgcttcgcgtccgggcgacatcgtcaccaccatgagcggccagaccgtggaaatactcaacaccgacgccgaaggccgcctggtgctgtgcgatgccctgacctacgccgagcgcttcaagccacaggcggtgatcgatatcgccaccctgaccggtgcctgcgtggtcgccctcggttcccacacctcgggcctcctgggcaacaacgacgaactgatcggccagttgctgagcgccggcgttcaggctgacgaccgtgcctggcaactgccgctgttcgacgagtaccaggaacagctggacagcccgttcgccgacatcgccaacatcggcggcccgaaagccggcaccattaccgctgcctgcttcctgtcgcgcttcaccaagcagtacaactgggcgcacctggatatcgccggtaccgcctggaccagcggcggcaaggacaagggcgccactggccgtccggttcccctgctgacccagtacctgttggaccgtgccaaagcctgaaacctatgacctcggggtgcgccgcccacacgcggcgcactcccgggttcaggaaccgcaatgaccaaagtcgacttctatatccttcccagcgcggatccttcggcgcgtctggacttcgcctgcaagctcaccgacaaggcctggcgcatggggcaccgcatctacctgcattgcagcgacgcggcccagcgcgatgagctcgatgtccggttgtggcgcttcaagggcgaaaccttcgtgccccatggtcccgccgaaagcgaaccggatggcctgatcgttctcggcctgggcgaagaccccggcgagcaccatgacctgttggtcaacctggacctgaaagtcccggcatttgcccagcgtttcgcccgcatcgccgaagtggtggtggaagacccgactattcgccaggccgctcgcgagagtttccgtttctaccgcgaacagggctatcctctgcaagatcaccgtttacagcgactctgagccatcgatggacactcccaaaccgctgcaaaagtccgcgcacctgctggatgacctcgagtccatccgccaactgctcggcgatgacgacctgcaacctccgctgctgaccgagaccgtcgacggcgaagtgcagattccgctgctgttcgatatggtcggcggcaagcctgccgtcgaaacccacgaagaggcgccggcagaaccacaaccggctcccgctccggtggtcgaaccgcaacccgcccccgtagttgccgcgccagcccctacaccggcaccgacaccgaaaccggcgccagcacccaagagccaggatgccctgttgcacctggacagcgaactgcgcgccgccgcgcaactgatcatgcaagacgtgatcgacgacttcgccccgcacatcgaaaccgagatcaagcgccgcctcgacgcgcgaatggatcgtttgctgagccagtacgacgcctgatcccctgccgtattccgcggacaaacctcgcagctacaggccacccagcgtctgtaggcgcgaggcttgcccgcggtaacgtcctggcggcaagcaaaaaccccgttcattgggcaactttcgccctcccgccgtcagcctgctctacgcgcatcggctcatccccgctatacttcccggcttttcctgaataaatgccaatagggtcccgccgcgcatggataagacctaccagccgcacgccattgaaacttcctggtaccagacctgggagtcagagaattacttcgccccgcaaggcgcgggcgactcgtacaccatcatgattccgccaccgaacgtcactggcagcctgcacatgggccatggcttcaacaacgcgatcatggacgccttgatccgcttccgccgcatgcagggccgcaacaccctgtggcagccgggtaccgaccacgccggtatcgccacccagatgctggtggagcgtcagatcgaagcccagggccagaatcgtcacgatctgggccgggaaaaattcctcgagaaagtctgggagtggaaggatcagtccggcggcaacatcagccgtcagatccgccgcctgggctcgtccgtcgactggagccgcgagcgcttcaccatggacgacggcctctccgaagccgttaaagaagccttcgtgcgcctgcacgaagatggcctgatctaccgcggcaagcgtctggtcaactgggacaccaagctgcacaccgcgatctccgacctcgaagtggaaaaccacgacgagaaaggctcgctgtggaacctgcgctacccgctggccgacggcgccaagaccgctgaaggcctggactacctgatcgttgccaccacccgcccggaaaccatgctcggcgactccgccgtggccgttaacccgaacgacgaacgctaccaggcgctgatcggcaaattcgtcgagctgccgctggtgggtcgtcgcatcccgatcatcggcgacgattactgcgaccctgaattcggcaccggctgcgtgaagatcaccccggcccacgatttcaacgactatgaagtcggcaagcgccacaacctgccgctgctgaacatcttcgacaagaacgccgaagtgctgcctgccgcccaggtgttcaacctggacggcacgctgaacgaaagcatcgacggcaagatcccggccgaattcgccggtctcaaccgcttccaggcgcgcaaggaaatcgtcgccgcgttcgacgccgccggcctgctggtcagcgtcgacgaccacgccctgaaagtaccgaaaggcgaccgctccgacaccatcatcgagccgtggctgaccgaccagtggtacgtctccaccaagccgctggccgagccggccattgccgccgtggaagacggccgcatcgccttcgtgccaaaacagtacgaaaacatgtacttctcctggatgcgcgacatccaggactggtgcatcagccgccagctgtggtggggccaccgcatcccggcctggtatgacgagtcgggcaaggtctatgtaggccgcgacgaagccgaggtgcgcgccaagcacaacctcgggcctgaggttgcactgcaacaggacaacgacgtcctcgacacctggttcagttcgggcctgtggaccttctccaccctgggctggccggagcagaccgaattcctcaagaccttccacccgaccgatgtgctggtgaccggtttcgacatcattttcttctgggtcgcccggatgatcatgctcaccatgcacctggtgaagaacgaagacggcacgccgcaggttccgttcaagaccgtgtacgtacacggcctggtacgcgacggccagggccagaagatgtccaagtccaagggcaacgttcttgacccactggacatcatcgacggcatcgatctggaaaccctggtgcagaaacgcaccaccggcatgatgcagccgcaactggcgaagaagatcgagaagcagacccgccaggagttcgccgacggcatcgccagctacggcaccgacgccctgcgcttcaccttctgctcgctggcgtccaccggccgcgacatcaagttcgacatgggccgcgtcgaaggttatcgcaacttctgcaacaagatctggaacgccgcgcgctacgtgctggacaagggcgaggactgcggtcagaacggcgaagcctacgagctgtcgctggccgaccgctggatcatctcccagctgcagcgcaccgaagccgaagtgacccgccagctggaccagttccgcttcgacctggcagcccaggcgctgtacgagttcatctggaaccagtactgcgattggtacctggaattgtccaagccagtgctgtgggacgaaaacgcgccggtcgaacgccagcgcggcacccgccgcaccctggtgcgcgtactggaagtggcgctgcgcctggcccatccgttcatgccgttcatcaccgaagaaatctggcagcgcctggcgccgctggccggcatccagggcaagaccatcatgctgcagccttggccggtggccaatgaagcacgcatcgaccaggccgccgaagacgacatcgaatggctcaagggcctgatgctcggcacccgtaacatccgtgccgaaatgaacatcggcccgggcaagccactggcgttgttcctgaagaacgtcaacgccgaagaccagcgtcgcctgagcgaaaacgagaccctgctgaagaagctggccaaactcgaatcgatcaccgtgctgaaggccggcgacgaagcaccgctgtccgccaccgccctggtcggcgagatggaagtgctggtgccgatggccggcctgatcgacaagggtgccgaactggcgcgcctggacaaggaaatccagcgtctgcaaggcgaagtccagcgggtcggcggcaagctgtccaacgccgccttcgtcgacaaggccccggccgaagtcatcgacaaggagcgcgccaaactggccgaggccgaacaggccctgggcaagctggccgagcagcacgcacggatctccagcctgtaacggcgactcgagcggtaaaaaaagggagccctgcaaaggggctcccttttttgtgcccgaccgacaggcttggcgcttctgtaggagcgcagcttgctggcgataaaggtaacgcggtgtgccaggaataacgcttcgcgggcaagcctcgcacctacagaggccacgcggtctgggcagatatgggacaatgcgcgccaccttgagccatacccgaaccgatttcgcccatgactgccccccgccctcccaaagctccgcgcaccaagcctcaacctgcagctccggccaaggccgtcgcaccacgggaaaaggccagcctgcacccgcgcaatcgccatcaaggccgctatgactttccacagttgatcaagagcaccccggagctgggggcgttcgtgatcatcaatccctacggcaaggagagcatcgacttcgccaatccggcggcggtgcgggtgttcaaccgggcattgctcaaggcgttctacggcatcgcccattgggatattccggccgacttcctctgccctccggtccccggtcgtgccgactatgtgcattgcctggccgacctgctggccgagcgtaacgaaggcgtaattccccgcggcgcggcggtgcgggtgctggacatcggggtcggcgccaactgcatctacccgttgatcggccactgcgattaccgctggcaatttctcggttccgacatcgacaccacggccctcgccgccgccaaggcgatcatccaggccaacggcctgaacaaggccatcggcctgcgccaacagaccaaccgcaagcagatcctgctggggctgctggagagcgacgaacgcttcgacctgaccctgtgcaatccgcccttccatgcttccctggaagaagccacacgcggcagccagcgcaaatggcgagcactgggcaaggccgatcccaagcgcaagctgccggtgctgaactttggcggccaggcggcggaattgtggtgcgaaggtggcgaagcgcgcttcgtgacccagttgatcggcgaaagcgcccaggtggcgcaacaggtgttgtggttcagcaccctggtgtcgaaagcctcgaacctgccggcgattcaggccgcgctgaaaaaggctggagcactggagagtcaggtggtggaaatgtcacaggggcaaaaacagagccgcttcgtcgcctggaccttcaaggacaaggcacagcaacaggcctggcgccaggagcgttgggttcaaaagggatagatacgaggggtaaaacggcgatttaccttgcgtaaatcgttgcggccttagagcctgaaaaccgtgcccggaagcgttccgaggcacggtcttactgcagtcttacttgttgatcgagtcggtcaggcctttagccacaaccagcttgataactttcttggcagcgatttcgatggcagcgccagtcgatgggttacggccagtacgggcaggacgctcggtcactttcagtttgccgatacctggcagagtgatttcgccgccattttccaattgatcagcaacgatctgggccagttggtccagagcgttacgcgcggtggttttcggcgcgtcgatagcttcagcgatatcagcgatcagttggtctttagtaatagccattgtggtgttccttccctatcaaattcatttggattgcagagtgcagtgtcagccatcgagccagatcttgtggatctggcaccccggtcacaaccacgaaagatcggggttatagataccgaaatcagggtttggttcgacctgacaaatgctgaatgcacgcttaacgccgagacatcgcgtaagacggggcaaaactagcacagagacggggaaatatccgcctctacctagccatttggtcagctttattgctctaaatccgtaaaaaaatgcataagcttgacccaggccgccttccacccccttcaaacagcgccaaaaccagcgggtgcggtacactgggcactttttcggggagtcacgccctctcccgccaaccagccgagaagcccatgccgatccgccattgcatcgtccacctgatcgacaaaaaacccgacggcacacccgcagttctgcacgcccgcgattccgaactggctgaatccgcggccatcgagaacatgctcgccgatctcaatgaaagctataacgccaaacagggcaaagcctggggtctgttccacccggagtccggcgcttttcccttcagcggctggctgaaggaatacctcgatggcggccaggacttcaccgccttcagccgcgtcgcggtcgagcacctgcaaaagctgatggaagaatccaacctgtcggtcggcggccacgtgctgttcgcccactaccagcaaggcatgaccgactacctggccatcgccctgctgcaccacagcgaaggcgtggcggtgaccgacgagctggacgtgaccccgtcccgccacctggacctgggccagttgcacctggccgcgcggatcaacgtctccgagtggcagaacaacaaacagtcgaaacagtacatctcgttcatcaagggcaagaacggcaagaaagtctcggagtacttccgtgactttatcggctgccaggaaggcgtcgacggcccgggcgagacccgtaccctgctcaaggcattcagcgacttcgtcgaaagcgaagacctgccggaagaatccgcccgggaaaagaccaaggccctggtggactacgccagcagccaggccaagctcggcgaacccgtgggcctggaagaactctcggagctgatcgacgaggaccgccccaaggcgttctacgatcacatccgcaacaaggactacggcctgtcgccggagatcccggcggataaacgcaccctcaaccagttccgccgcttcaccggccgagccgaaggcctgtccatcagcttcgaggcgcacctgctgggctcgaagatcgagtatgacgaagaggccgggaccctgatcatcaagggcctgccgacccaactgaccgatcagctcaagcgtcgcaactgatgctgcagggcgtgctgaagaaattcctgctgatcctgctggtggtcgtggcgtaccagaactggggcaagctcgagcacctgttcaacccctcgcaggcagcctccgagcaggtccgggccaatgcccgggtggtgctctacgccaccgactggtgcggctactgcaaggccacccggcgctttctcgatcagaagggcattgcctttcgcgagttcgatatcgagaaggatgccgaggcgcgcaaggcctataccgagctgggtggcgccggaattccgatcctggacgtcaatggcatcttgatccgtacctatgaccccgacgggatcatggcggcgttgcaacgttaaacgcatcgcgagcaagctcgctcctacaagggccgaacaacctctgtcggaacgagcttgcttgcgatagacctgccgccttacagcgcctcgatacggaacccgaaacgcgggaagtgcacatgcaccaatccgccgcgtgggtcttcgcggcgcaggatcaactcctcgcgcccggcaaacagcaactccccctccaccggatcgacgccatagtcggtcgccgcgatccgcacccgctggccagcctggaaaccgttcgggtcaatgaaggcttcatccggcaaggctgccggtgtagccctgcgcgccacttcgagtgcctcttcggaagtcatggcactcgaagcaccatgaccgaaccccagtacccgggccagccacgccgacaccgccggataggcgtccaccagcggcgcagtcaccggcgtgcccttgaggaaccacaaggggtgggccatggcgaagtcggcaatcgacggctcaccgaacaggaagtcgccctcctcacgctgcaactgctgctccaggcgcgccatgagcgtcggccattgatgcttggccaactccagcggcacccgggtggaactgccgccgctgaacagcccggcgcggtctgtcatgaaggccttgaccgcttccggcgacaaatggccgaaacgcacggccgctgactcaggctggaacaccaagctcaccgtatgctggaacaccaccgaatcggcccaggccgcgaaggtcgcgctgaccatttcccggccttcgggaaacagtgccggcgaggctttttcctgctccagccgccgggcgatcagcgccgtgtcgcaatagatatcggcaccgacctgcaacaccggggtcttgcgataaccacccgtgagcgccgtgagatcgggtttgggcatcactggcgagatcttcaccgagcgccaggacaagcccttgaagcctagcaacaggcgggctttttccgcgaaaggcgaggtcgggtaatgatgcagaatcaactctgacatgctggggtccaccggataagtaggaagaaccagcttagcgtgcaaagacagggcagcctatataccctgtccgatcatcatccatcaccgacactgatcgggcaccgcgcttcaccagaccagccgcctgagcatgatagggaatccagcctttggcctttaagaacatgaaccccgtacgggcctattacacccgttttttatatttttgcgtttacaagttcccgaaactctttacctataagttcaagaaccatttcttcttttactcggtgcagctgtataacccaaaggaaagtacagctgtctatcagcaggcaagccttctggaagggccgggacaatggcgatcggtcagtatcatcacccccatcacacccaccgagttgatgtctcttcgcggatggtttcatagaaaagaacctccgtaccacgaagacggccctgaaagttcgaccccgcacaccgaggcggcgatctttccagtcaaggggcttggctatatcccattcaatgacaccaacccttatgacccaagccgggtatcggtaaaaaccgacgccttcaggacctgcactatcaccaccatcgagttgaccaacagtgtcacttacctggcgctcgatttctccctgcaagacagctcgcagacagaactgttcaacctgaatacttcccatatccacgattaccatgccttcaagacgataaatcccttctcgaagaactttcgcatcgttcattccagttactacgtagaggaactattgactcagggcgtcaacaggattgtcggcgacgctcaccaggtcgcggaaaagctgttcaaactttggggtatccgtgcacaagcccactcccgcatcaccaccgggcgccttaaaagcgagctgagcgccccatacatcaacctctacgccagcagtgactataaccattactccctgatcagccgctaccccggcagacaatgcgactattaccgcaacgaatcgggcaatttcagctacctctataacttcgaatcgagctcattgaacctggatgcattcttcatcgataacctcaatgaccctcacgacataaacgactgcttggccaactacctccacctgtcgttgatcaaggaactctggcatcagtacaaccaatgcagggacgacgtgaatccggtgctttcgaccataagccagaacacttccgagagcctgcaaaccctgttggaaacaaacataaggattgaacgtatcgaggaaaagatagaggccctgacacagttcagcgatcagtcctattgcccgagctttcgaaccgaggcagaagacgaactgaaaaggctggtggagaaaatcgagttactgaaaaaacgcatcgcccaacgaaagtccctcagcaacgatcaggtgcaattcgagaacctcaagttcaatcgtttctactcctggatagtcggcggcctggcctttcttcaggttttcctggccgctatcgtcatcgactggagccaggcgctgcaaagcaacaatccggtattgaacaatctgaaagccctgctgctctggcttcagggttaagcccccccgactctgacagaatcaggtatccagatcccaactggccaccaggcattccttggcgcttttccggagtttcttgatcagccgttcctggcgcagggcttcgctcttgtcgcgacaggcttcggtgtagaccagcgcgacggccgggctggagaggaagaagcgtgcgcccttgccgctctggtgcttggcgaaacgcttgaccgggtcgtcgctgatgccgcagtacagggcgccgttggcggcgcgcaccaggtagacaaaccagggtttgctcaccaccggtacaggctcggcgtcgttggcaggagattggctggggcgggtcacggtgatcgcggcctgtggataacaagccgcgatcttaccagaggcgaagattcagcggccggcctggaaggcgttcaggcctttgcgggcctgggcgcgcacggcgtttttcagcagcggggtccagccgaggatcaggcccttggtgcccagggcctggcgggcccagcgccacatattgaaatgatcatggtgctcgcagatcttgccgtcacggaacacgaaacgcgcctggatatcgttgaccacggtattgccagtctggctgaacaggtaagtcgccacccaatgggcctcgccactgcgctcgtcggcgcggacattatcgaaggtcagggagaagtccttggcccgggtggtgagcatgcgccacatgtcagcggcatcgcggccgcgcagttcgccgaacgccggatcactgaacagcacatcctcggtgtagcaggcggccatggcctcggcatccaggcgctggaaggcactatagaactcagtgatcaaggcgcggtgggcgtcactcatgaaacaggctccgactcagggaaagatgcctgcacgatagtctgcaaacccgggaaacactatcggcattcgccgcgcaaataccgacagtgggttggctcagattttttcgctttcgacctgcacgtagagcgagcgcccggcccccaggccggcgattatggcccctaggccgatcaccgcgaaaatccagcccaaggccgtccagccgccggtccagtcgtgcaccaggccgaccgcgaacggccccatggaggccagggtgtagccaaagccctgggccatgctcgacagattggccgccacatgggcgtccttcgaacgcaggacgatcagggtcagcgccagactaaaagtaccgccctgccccacgcccagcaggatcgcccagccccacaggccatcgagcggggcatacaggcagccgaacaggccgccgagggtcagcagcatcaccaccacgatagccaggcgctgatccttgccccgcgttgccagccagggcgcggccagcgaactggcgagctggacgatcaccgagccggacagcaccaacccggcctgggtcgggctcaggccgcgaccgatcaggatcgacggtaaccagccaaacacgatgtaggccagcgaggattgcaggcccatgtacagcgtcacttgccaggccagcgggtcgcgcagcaaaccgcgcacccgataggccacatggtgcgcgccctgccgcttgccgacctggggcagccagaacagcgccgctaccagcgccggcagcacccagaagccgaggcccagcgcccagctgttatcgaagtgctggctcaagggcacggtcgcccccgcggccatcgccgcgcccaggcacagggccatggtgtagacgccggtcatggtgcccgcgtgtttggcgaagtcgcgcttgacgatgcccggcagcaacaccccgatcacgccgatgctagcgccaccgaggatgctgccggcgaacagcccgacgtctcccagggaactgcgcagaatgatcccgcccgccagcgtcagcaggatgccaagcaccacccgctcggcgccgaagcgccgcgccagcaccggagccagaggagcgaacaggcccaggcacagcaccggcaaggtggtcagcaggccggcctgggccgccgacagcccgaggctgcgcgacacctcgctgagcagcggcgccatgctcgacagcgccggacgcaaattcagcgccaccaggatcagccccagcagcaacagccacgggcgacttggggccaggtggccctgctggacctcggcatcgtcggcttcggcatcgatcaacaactcttcgagctcagcctcgcgtcgaggaacagcgataggtggcgggttattggcctgatggctggacatggcgctctcggtctcaaggttcattgatcagctgccgcgaaatggccttggcccgctccggatcgcgctgctcgacggcgtccagcaggtcgatgtgcagatcgaacaccgcctggcgccgaggatggatgttcagggtctggcgcagttgcgcgccgaccacgctggagaaatagcggtacagctcgctgagggtggggttatgcgcggcgtccaccaggcgcccgtgaaacaccaggtcgcaggcgatatagctctccagatcgccgtgatagtgatcgccactgagagccagggcttcgcgcaacgccagcaggtcctggtcggtacgccgcagtgccgccaggccgatggcttcggtctcgatgatctgccgggtttcgcgcgcctgctccagggagcactgggacagggccttgagagtgtccagcggatcgaccaccgcacgcaggtaactaccgtcgccctggcgaatctccaccagaccggaaaacgccaggacccgcatggcttcgcgcacggtattgcggctgatgcccagctccgccgccagctccggttcggtcggcaggcgctggccgatgccccatacaccgtcattgatgcgttggcgcagctgttccagggcctgatcgaccagggaacgtttaatcaaaggagaagtgtctgtcatatgccgtcgccttttcatccaatcatcggatgaatttttttggcatattagtcagcttcgcgtgggtgaacaacaaagccgatgcatgcatgtagcaagcggaaaggaaatccgattgctaaaaaaaccctttaagggtaatttcatctcgactccaggtgtcttatggaaaagcacacacctcattacgacctgtcggtgatcaaggcggatgtcgcccgtctgggggcagccgcctttacccgaaccgccctggtcagcggccggcacctcggcctgacctgccgggacatgcagcaggtgattgccgggctgcaggggaaaatgctctacaagtcgatgaccagctatctcgatcatcgaatctggcaggacgtgtattacacgcacctcgattccgtggagctgtacatcaaagtcacttatcgccccggcggcggtcccccagtgatctccttcaaggagaaacacccatgaaacaaagacaatgcgtcagttgcggggccccggccagcatgcagccgttcgagaaccgcagcgagctgatcgattacaagcacatggtgcgtcaggttcatggcctggccggctgggaatgccaggcctgcgcagaaatcgagttcgacgccgccagcgccgaacgctacgccagcgccggcgaccaattgctggaagattgccggcagttcatggccagcgagatgaaacgcatccgccgcaagctgcacctctcgcagaaggatgcggtaaagctgctctccggcggcgggcacaacgccttctcccgctacgaacgcggcgaggtcgccccgccccagccgctgttcatgttgatgcgcctgctcgatcgtcatccgcagctgatggctgatgtgcaggcactcagcgaacaacaagcgcccgcggccgacgacgatccgcaccaggcacgcgtcgcgacgtcgtgaaatcccaggcaaaaataaacccggcgccaggccgggttcattttcaaggctgtgcctggatcagtgcaggatctggctcaggaacagcttggtccgctcgttctgcgggttgtcgaagaagtcgttaggcgcggcctgttcgacgatttcacccttgtccataaagatcacccggttggccacggtgcgcgcgaagcccatttcgtgggtcacacagagcatggtcatgccgtcttcggccaggccgatcatggtgtccagaacctctttcaccatttccgggtcgagggccgacgtcggctcgtcgaacagcatgatcttcggcttcatgcacagcgcccgggcaatcgccacgcgctgctgctgaccgccggagagttggcccgggtacttgttcgcctgctccggaatgcgtacgcgctccaggtaatgcatggcgatttcctcggccttgcgcttgggcatcttgcgtacccacatcggcgccagtgtgcagttctgcaggatggtcaggtgcgggaacaggttgaagtgctggaacaccatgccgacttcacggcggatcgcctcgatctgcttgaggtcgttggtcagctccacgccatcgaccacgatgcggccctgctggtgttcttccaggcggttcaggcagcggatggtggtggacttgcccgagcccgaaggcccgcacaggacgatgcgctcgccctgcttgacgttgaggttgatgtccttgagcacgtggaactggccgtaccacttgttcacgccctgcatctgaataatgccttcagggctcacaggctttttgatcgcttcactcatggagatactcctaacgcttgtggcctgtgtccaacttacgctccagatgcatggagtagcgggacataccaaaacagaaaatccagaacaccagggccgcgaagacatagccttcggtggccatgcccagccatttcgggtcggcggcggcttgtttcacgctgttgagcaggtcgaacaggccgatgatgatcaccaggctggtgtccttgaacagggcgatgaaggtattgacgatgccggggatcaccagcttcagggcttgcggcaggatcaccaggcccatgctgcgccagtagcccaggcccatggccgcggccgcttcgtactgccccttgggaatcgcctgcaacccgccgcgcaccacttcggcgatgtaggccgactggaacaggatcaccccgatcagcgcccgcagcagcttgtcgaagttcatgccttcgggcaggaacagcggcagcatcaccgaggacatgaacagcacggtgatcaacggcacgccacgccagaactcgatgaaggtcacgcagaccacacgaatcgccggcatgttcgagcgtcgccccaaggccagcacgatgcccagcggcaaggcgccggcgatgccgacggtggcgatcaccagggtcagcatcaggccgccccactggctggtggcgacgttggccatgccaaacaggccgccatgcagcaggaagtaggcaatgatcgggtacagcaccaggaagctcaggccataaatggccttgtgcggaacccgggcgatgaacaagggcgccacaccaatcaccgccagccacacggtcaggtccacgcgccagcgcaggtccgccgggtagtagccgtacatgaactggccgaagcgctgctggatgaacacccagcaagcgccctccttggtgcagtcggcgcgggtggtgcccacccagttggcgtcgaaaatcgcccagctaaggatcggcggcaccaccaggtagatcaggtagaaggcaaacagggtcagcagggtgttgatccagctggagaacatgtgtgcccgcatccacgccacgatcccgatgctgctgctcggtggtggcatgtcgggtttgaaagtatgagtgctcatgcgcgtttcctcaccgctcgatcagcgcaatgcgcttgttgtaccagttcatcagcagggaaatgctgatgctgatcgccaggtacacgctcatggtgatggcaatgacttcgatggcctggccggtctggttgagcacggtaccggcgaacagcgaaaccatttccggataaccgatacccgccgccagggacgagttcttcgccaggttcaggtattggctggtcagtggcggaatgatcacccgcagcgcctgcggaatgatcaccttgcgcagggtcgggccgttgcgcaggccgagggagcgggccgcctcggtctggccgtggctcaccgacttgatccccgaacgcacgatctcggcgataaatgccgcggtgtagacggtcagggccagggtcagggccagcagttccgggatcagcacccagccgccgacgaagttgaagcccttgagttcgggcatttcccagtgcaccggggcgccgaacaccagcatgcacagtgccgggatcaccaggaacagcgccaggccggtccagaacttgtggaacggcacgccggtttcttcgaagcgcttgttggcccagcggcacatcagcacgatggcaacgatggctatcaccaggctgatcacgaacggccagaagccgtcggccaccagggccgccggcatgttcaggccacggctactgacgaagaaggtgtcgccgaagttgtggctgttgcgcggccccggcatggtcaggaacaccgcgaaataccagaacaggatttgcagcagcggcggaatgttgcggaacacttccacatacacagtcgccaatttgctgatgatccagttctgcgacaggcgcgccacaccgatgatgaaaccgaggatggtcgccaggatcacgccgatgaacgtcaccagcagggtgttgagcaggccgatcacgaacacccgggcatagctatccgcttcggtgtaggagatcaggtgctgagcgatgccgaagccggcgctgcgctcgagaaagtcgaagccggaggtaataccccggtgctgaaggttggtttgcgtgttatcgaacaagtaccagccaagcgagatcacggccacgacggtaatgatctggaatagccacgcacgcactcgtggatcgctgagactgagcctctgcttaggtgcgccgattgagttttgcatgaagtgccccggaaataatggaacaagaacatcacccggcggttggcccgccgggcgatagaaccatcagcgcactggtggtgcgtattgaatgccgccgttgttccatagcgcgttcaggccgcgatcgatctccagcggagtgctcttgccgaggttcttctcgaacacttcgccgtagttgccgacttgcttgacgatctgtaccacccagtccttcggcagtttcaggtccttgccgtattcaccgtcggcacccagcagacgcgcaacgtccgggttcttggtggacttggcttcggcctcgacgttcttcgaggtgatgccggcctcttcggcgttgagcatggcgtagcccgtccagcggatgatggccagccactcgtcgtcgccgttacgcacgaccgggcccagcggttccttggaaatggtttccggcagaaccacatagtccttcggcgaagccagcttgctgcgctgggcgaacagctgggacttgtcggaggtcagtacgtcgcaacgaccggactccagcgacttggcgctttcatcggaggtgtcgaaggtgatcggggtgtatttcaggccgttgccgcggaagtagtcggacacgttcagctcggtggtggtgccggcctggatgcagatggtcgcgccgtccagttccttggcgctcttgacgcccagcttgttgttcaccaggaaaccgatgccgtcgtagtaggtgatgaagcccgggaatttcaggcccatgcccgcgtcgcgggaactggtcatggtggtgttgcgcgacaggatgtcgatttcgcccgattgcagcgcggtgaaacgctccttggcgttcaactggctgaatttcactttggtcgcgtcgccgaataccgcggcggccacggcgcggcagatgtcggcgtcgatgccgaggatcttgccggtggcgtccggtaccgagaagcccggcagaccgtcgctcacaccgcactgcacaaagcctttcttctgcaccgcatccagggtcgcacccgcctgcgcgaagccgctcatgcccagtaccgcggcggccgtgaccacagccagggtggatttcaacatcttcattcaaacctccagttttgctcttgttgtgtcggagcttgagtcccgccgcacccttatgaggcactgttgacccgtgttggctttttatggggtcaagcggcgtaggactttagctatgagtctagtaggagaaaatccatttaagagaaaacccatactcaccaagcgaccgaacgggctgtagcccttgcatgttcgcgaagcccgtagcggccactggcgaacgtccatcatcggatctttgctatcccacacccgccagtagcctgatagtgttaccggcagggtgaacgcaatcacttcacgcaacggctatagcaaagcccgtaccagagtgccggctaaagcggctcagcccggggtcaagagcaaaacttgcagccttgcgacatcttcttaactgatcaaccgaccgcgcacctcgatcacgcaccgcttgggcgcgtgcgcacatatttggagcaaccatgaccgagcccttgattcttcagcccagcaagcccgtcgatgcctgtgtgatctggctccatggcctgggcgccgatcgctacgacttcctgccggtggccgaagcgctgcaggaaagcctgttgaccacccgcttcgtcctgccccaggcaccgacccgcgccgtgaccatcaatggcggttatgccatgcccagctggtacgacattctggccatgagcccggcgcgcgcgatcaaccgcgaacagctggacgagtcggcaaaacgcctgaccgacctgatcgaagaacagcgcgccagcggaatagacccttcgcggattttcctcgccggtttttcccagggtggcgcggtcgtcctgcacaccgccttccttaaatggcagggcccgctgggtggcgtgcttgccctctccacctatgccccgaccttcagcgatgaactcgaactgtcggccagccagcagcggattccgaccctgtgcctgcacggccagtacgacgaagtggtgcagaacgccatgggccgcaccgcctacgagtacctgaaacaccatggtgtcaccgtgacatggcaggaatacccaatgggccacgaagtgttacccgaagaaattcgcgatatcggcgcctggctcggcgagcgtttgcgctgaatcgataagttaggtagcccgttgagcaatccactacgccgcgcccgattcttgcattacactgcccggcgtacattccttaaccaattgatgagatgaccgtgctcaaagcactcaagaaaatcttcggtaaaagcgaggctgagcagctcgcgccaggctccagcccctcttcctccagccccagcagccgtaccgacggccatcagccggaacggaccgcgcccgcccccgtggccaggcaagagccggtggccccagccgccccagtggcccagaccgcgccgcgcagcgacaagcccaaggccgaacagccgcgccgcccacgcgcgccgaaaccaccggtaagcacctggaaactggaagacttcgtcgtcgaaccgcaggaaggcaagacccgtttccacgacttcaaactcgcgccggaactgatgcacgcgatccacgacctgggtttcccctattgcacgccgatccaggcgcaggtactggggttcaccctggccggcaaagacgccatcggccgcgcccagaccggtaccggcaagaccgctgcgttcctgatctcgatcatcacccagctgctgcagacccctccgccgaaagagcgctacatgggcgagccgcgggcgctgatcatcgcgccgacccgcgaactggtggtacagatcgccaaggatgcggccagcctgaccaaatacaccggcctcaatgtgatgacgtttgtcggtggcatggacttcgacaaacagctcaaacacctcgaagcccgccattgcgacattctggtggccaccccgggccgcctgctggacttcaaccagcgcggcgacgtgcacctggacatggtcgaagtgatggtgctggacgaagccgaccgcatgctcgacatgggcttcatcccccaggtacgccagatcattcgccagaccccgccgaagagcgaacgccagaccctgctgttctccgccaccttcaccgacgacgtgatgaacctggccaagcagtggaccaccgccccggctatcgtcgaaatcgaagccgagaacgtggccaacgccaacgtcgaacagcacatctacgcggtggccggcgccgacaagtacaagctgctgtacaacctggtcaacgacaacggctgggaacgggtcatggtcttcgccaaccgcaaggatgaagtgcggcgcatcgaggaacgcctggtacgcgacggcgtgaacgccgcccagctgtccggcgacgtgccgcagcacaagcgcatcaagaccctggaaggcttccgcgaaggcaagatccgcgtgctggtggccaccgatgtcgccggtcgtggcatccacatcgacggcatcagccacgtgatcaacttcaccctgccggaagtgccggacgactacgtgcaccgtatcggccgcacaggccgggcgggcgccgacggtgtgtccatcagcttcgccggcgaggacgactcctatcagttgccgtcgatcgaggcgctgctgggccgcaagatcagctgcgaaatgccgccgaccgagctgctgcgccccgtggagcgcaagcacgcccgaaagcctgatcgcgagtgaacgaagggaggttccaatggaaccttccgaacgaaaaacgcagcccgaccacaggctgcgttttttttcgcctggatattgctcaccaaaactaaaagtccataatagacaaattagtttgtttttatggagtacccgcatgtccagcgcgccgtccgtgatgacccagcctcaagcccgccagttgctggcgcaggtcgacgtgccgcaggttttgcgcaagctgttccacgacctggccgccggccttgccgtgcagccggcgcagcaactggtggagtttccccagggcgccggggactttatcaattacctgggcgtgctggccgaagagcgggtctacggggtcaagacctcgccctatatcgtccgcgccgaaggtccgctggtcaccgcctggaccctgctgatgtccatggacagcggccagccgctgctgctctgcgacgctggcgaactgaccaccgcgcgcaccgcggccaccaccgccgtggccgtcgatgccctggcgccggccgacgccaggcacctggcgatcattggcagcggcccggtggcccaggcgcacctgcattacgtgaaagccctgcgcgagtggcaatccatccgcctgtactcccctggcctggccggcaaatccaccgaggacatcgcgcgcctgaaggccctcgacccgcgcctgcaggtcgccagccagctcgatgacgccctggaggacgccgacgtcatcatgctctgcacctcctccgccggcccggtgatcgacccgcgcaccttgcgcaagccggcgctgatcacctccatcagcaccaacgcgccacgggcccacgaagtcccgcccgccgcgctgaaggacatgcaggtgtattgcgactatcgtcagaccacccccggctcggccggcgagatgctgatcgccggcgaacagcatggctgggacaaggcggcgattctcggcgacctgcccgaactgctcagcgacctggcgcaacggccggagccggggcgccacgtgttcttccgctccatcggcctgggcctggaagacatcgccctggccaatgctctctatcatctgcaacgcaacgcatgaacgaacctgtaggagcgagcttgctcgcgataaaagactgaacactacgcggtgtcgttggcgacctcatcgcgagcaagctcgctcctacagggacttgcattgactctttttctggaggttcgaatgacccaggcagacttcatcatcatcggcggcggcattgccggtgcctccaccggctactggctgtcgcgccatggccgggtgctggtgctggaacgcgaatcgcatccggcctatcactccaccgggcgctccgcggcgctctataccgccgcctatggcacgccccaggtacgcgccctgaccctggccagccgggactttttcgatgccccgccgcaagggttctgcgagcacccgctgctgactccgcgcggcgaaatgaccgtggacttcaccggcgaccccagcgagctgaacaaccagtacctgagtgccaaggccacggtgccggagatgcagctgctgagcgccgacgaagcctgcgcgcgcctgccgatcctgcgtcgcgagaaggtccacggcgccctctacgacccaagcgccagcgacatcgacaccgacgccctgcaccagggttacctgcgcggcatccggcgcaaccagggcgaggtgcgtaccgactgtgaagtgctggggctgagccgcgacgaacaaggccaatggcaggtacagaccgccggccagaacttcagcgcgcccatcctgatcaacgccgccggcgcctgggccgaccaggtcggcgccatggccggcgcccggcccctgggcctgcagccgaaacgccgcgcagcctttatcttcgccggccccgaaggcgtcgatatccaccactggccgatgctggtgagcctcgacgaatccttctacatgaagcccgacgccggcatgttcctcggctcgccggccaacgccgacccggtggagccccacgatgtacagccggaagagctggacatcgccatgggcatctaccagatcgaagaggccaccaccctgaccattcgccgcccgacccggacctgggccggcctgcgcagtttcgtcagcgacggcgacctgctggccggcttcgacccccaggtaccgggcctgttctgggtcgccgcgcaaggcggctacgggatccagacctcgccggccatgggccaggccagcgccgccctggtgcgtggcgaagccttgccggaacagctggcgcgctttggcctggacgccgccatgctctcccccgcccgcctcggctgaccccgctcaggtgacgcgccccaacgattgcggcacactcgcagcgccctgcctcgcggggcgctgacaccgcctggagaaccacccatgacctcacccgcgcaggaccctgtcctggataacttccgggcgatcgccgatgccatcgccacgctgttcttcccccatgccgaggtggttatccacgatctgcgcacgcagaagatcgactacatcgccaacaacatctccaagcgcgaagtgggcgacgactccgccctcgaagacatgcttggcgaggacgccaatgagcggaatatcggcccctacgaaaagctcaactgggacggccagaagatccgcagcctcagcagcgtgctgcgcgacggcagcggccagccgctggcggtgctgtgcatcaacctgaatatttcgctgttcgagaatgccaaggcggcgctggacctgttcctctcgccgagcaaactgatcccgcaaccggactcgctgtttcgcgatgactggcaggagcgcatcaacaccttcctgcacaactggctgcgcgaacggcagctgggcctgaacctgctgacccgcgaacacaagcgcgaactggtgctggcgctgcacgccgaaggtgcgttcaagggcaaaagcgccgccaactatgtggccaacgtgctgaacatggggcgggcgacggtgtacaagcacctgaaggaattgaagggctgacggccccctgaaaagcctcgctccgacaaaaccgcaggagcgaggcttgcccgcgatggcgtcctcacgaacgccacgcgacatcagtcgccgtagatgtcggacttgaagtacttctcggaaatcttctgatattcgccactggcgcgaatgccatcgatggcgctattcaactggctgaccagctcggtattacccttgcgcaccgcgatccccgcgccctcacccacgtatttcgggtccttcagctctggcccgacaaacgcatagcccttgccacgcggcatcgacaggaaatcattcagcgggatggtgtccgcgaaaatcgcatcgaggcgcccggccgtcaggtccatgtagatctcttcgttattgctgtagcgcttgacgttgatgcccttgggctcgaacacctcggtggcgtagcggtcggtggtggtcgcccgttgcacaccgacgttcttgcccttgaggctggcgtactggtcatcgaccgtggcgccttccttcatcaccagccgcgaggaagtgaagtagtacttgtgggtgaagtcgaccgacttcttgcggtcttcgttgatggtcatcgacgacagcgccatgtcgatttttttcactttcaaggagggaatcaggccgtcgaattcaccctcgacccataggcacttgacctgcatctgcgcgcacagggcattgccgatgtcgtagtcgaaaccgacgatctcgcccttgtcggttttcgaggcgaacggcggataagccgcctcgatgccgatgcgcagggttttctcggcggcgaacaggctgctgcacgccaacaggctcagggccaggccactgatgagggggaatttcttcatgttcgttctctcgcgggttgttgttggtttggcaagacagaagaaaggagtgaaacggtgacgccttgcttgtacttgtaaatccatactggacttttacgtatatttcgtcaacgcagcggacgcggttcagccggcctttggtcgagagacagatatgggaaaaaacagggaaatggagggtgcagctgagggactatcgcgggcaatcgagcgtcgaccagccgctcctacatggccaggtgcttctgtaggagcgaggcttgcccgcgatggcggacttgcggtcaatacagagggatcaggcaatcattctttccaacgatccgccgccgcgtgatcgctgtcgcgaccttccacccagcgcggcccgtcggcggtggtttcctttttccagaacggtgcgcgggttttcaggtagtccatgacaaaggcacaggcgtcgaacgccgcctggcggtgggcgctggcggcgccgacaaagacgatcggctcgcccggctccagcgcgccgatgcgatgcagcacttccagcttgagcaacggccagcgctgttcggcctcggcagcgatcttgccgagggccttttcggtcatgcccgggtaatgctcgagaaacatcccggccacctccaggccatcgttgaaatcacgcacgtagccgacaaagctcaccaccgcgccgacaccgacattcgccgcatgcatggcgttgacttccgcccctggatcgaaggcgcccgattgcacacgaatcgccatatcagcccccggtcacggtaggaaaaaacgccacttcgtcgccgtcgctcaccggctcgtcgagctggcacaggtcttcgttgcgggcgcacatcaggttctgctcgctgagaacctcggcgccctcgcgttgggccagcagggcacgcacatcgtcgaccgtggcgaaatcgccggcgacccgcagcgagtccacgcccagcgcctcgcggtagcgggcgaaaaacttcacagtcaggttcattgttcatccgcctggtaatgaccgctcttgccgcccagcttctccagcaagcgcacgccttcgatggtcatgccccggtccacggccttgcacatgtcatagatagtcagggcggcgacgctggcggcggtcagggcttccatttccaccccggtctgcccggccagcttgcagcgggcaacgatgcgcacgctgtcctcgccttcggcgctgagctcgaccttgacgctggtgagcatcagcggatggcacagggggatcagatcgctggtctttttcgccgcctggatgccggcgatgcgcgccacggcgaacacatcacccttggggtgaccgccgctgacgatcatttgcagggtttgcgggagcatgcgcacccgggcttcggccgtggcttcgcgggacgtcacggctttgtcggtgacgtcgaccatattggcgcgaccttgggaatcgagatgagtcagcacagccttactcctgatcaggaaaggcgattgtaaacccgagggtcaattttccgcacgcttgattacgcgatccttgtagccgctggcgcaggctgcgatcggccgcgtagcggacgtgatccggacttccccagggttaccggtgaaacgcaacagttcctctggcgtctgctgcgcagccgatcgcagcctgcgccagcggctacagaagtttcatccaggcacaaaaaaacgggcggcctctcggccgcccgtctggcgagggttacagatgggattcggcgtattcggccagaatcgagcgtggcaccccttgcagggtgatgtgcaccccgttggggaagtccttgaagcgttcagtgaggtaggtcagcccggagctggtcgcggacaggtaaggggtatcgatctgcgccaggttgcccaggcacaccactttggaaccggcgccggcacgggtgatgatggttttcatctggtgcggggtgaggttctggcattcgtcgatcaggatcaggctctgctggaagctgcggccacgaatgtagttgagggatttgaactgcagcggcaccttgctgaggatgtagtcgacgctgccatgggtgctttcgtcatccatgtgaagggcttcgaggttgtcggtgatggcgccgagccagggctccatcttttccgcttcggtgcccggcaggaagccgatctcctggtccagcccctgcacgctgcgggtggcgatgatgcgccgataacgcttgctgaccatggtctgctcgatggccgcggccagggccaggatggtcttgcctgaacctgccgccccggacaggttgaccagatgaatgtccggatcgagcagggcgaacagcgccaggccttgatagatgtcgcgcggtttcaggccccaggcttcctggtgcaacaggggttcctgatgcaggtcgagaatcagcagcacatcggcgcgaatctccttgatccagccgacaaaaccctgttcgtcgatgatgaactcgttgatatgcaccgccggcaggttgtcggtgagttgcacctggtgccaggtgcggccgtgatcctggcgggtttccaccttgctcacgcggtcccagaaggaaccggtcatgttgtggaagccattgggcagcaaggccacgtcgtcgaccagctggtcggtgctgtagtcctcggcggcgatcccgcaggcgcgcgccttgaggcgcatgttgatgtctttggtcaccagcaccacgcgcagctccttgtcgcgcgcgtgcaggtcgatcaactggttgatgatgatgttgtcgttgaggttttccggcagcaggctgttgggctcggagcgcttgctcatgaggatcgacagcaggcctttggggccgctcttgccacgctggataggcacacccagctcgacgtcttcaggcgaggcctcacccagggtcttgtcgatcaggcgaatggcctggcggcattccgctgcaacactgtgatggccgctcttgagcttgtcgagttcctccaggacgatcatcgggatcgccacatggtgttcttcgaagttcagcagggcgtttggatcgtgaatcaatacattggtatcgagtacataaaggattggctggttggaggaagggctacgtccgtggtcatccatactcggtcaccttatgtgggggccagtcgacgcaataccatggcggtgctgcgcctcgaattgaccgtcgaattcacccgcaggggttcgagtgaagtgcacacaaaaggagtcttgggagacgccacctgtgttgcaggtttcggcggtctgacttcgtaatactccaaaacctgtgacaggaaaaagcactttgacgctttttttaagtttattttgcagagtgacgaatagcccttggcgcgctgcccctgcaccgttaaagtcggaagtccgcctgcctcgaaatcttggccaaaatctgcaaaaacctcctctccccccgtaaatacggacctttcgtcgtttctagcgaaacgcgtcctgacaatcctcccaaccgattccgctctgcgccgtctgcgtcagcaaccagggcaatgccgtcttcaccgcgtcctgccgggcgttgaaattgatcaccccgtgccgccacaacagcatcagggtcaacacccgctggccactctgctcacccttgagcttgccagcgccgtcctgcgggtcgatgtcccacagcgccacctgcaaaccctgtgcattaaagaaggcctgcgcatccgcccggcgctggccgtagggcgggcgaaacagcggcacgtagttttccggcagcttgcccttggccagttcgacgctgcgctcgatcgagtcctgccagtcttgccaatggctgtgggaacgatactcccagccctgcacacccacgcactgctgcgaatacagggcctgcaggctggccaccgaacgctgctccaggcggctctgcaactcgctgccaagcacgaagaaggtgccgttcatgttcgacttgcgcaggtattcggtcagccacggggtgttgtccggggcgagattggcggcgctgtcgaaggtcagcaaaaacagccggtcattgagctcgtcgccattgcgctcgtagtcgccaaaacgctcgatctcgctggcggtctggggaaacagcgcggccttgcgcagcagctcgtccagatactgttcatggaagatccggctcggctcggcccagcgggcgtaataggagtcgtcgcccaactggaacttgccggcctgctcgcgcagggtgtccatgtcttccaccaggaaacagaaggaagcgtcctggtcgcagctctgctgggcgaagttgtagttgctcagcaattgccgccagagccgctggcgaacggcatcgatcgacgccatgttgatgatccgcaggcccaggcgctgcttcaacgaagcttcatcccaggcctcgctgtccagcagggcgcgggcgaaggtgaggatttccgcccgcgacgccacgtcgaacagggttgggttactgagttgttccggccaggtgctgcgatccagggtcgccacctcgttcggcgccgccagggcgccgaaactcaacagccagatcgaaagaaaaaacgcgctgcgcaaagggatgtctccataacaaaacccgcgcggcactatagccgatgccggcctctcggccctattgcctaggccgctccccttccctttatagagagcggacacgcgcctccctgctgcaggccatcgccgatcgatggacgaccggcggcaccccctattgccttcataggtggagtcaaagcgcccaagcccctagaatcccccgacgcttacaggagacgacttcatgctgatggtgatttcacccgccaagaccctcgatttcgagaccccgcccgtcactcaacgcttcacccagccgcagtacctcgatcactcccaggaactgatcctgcaattgcgcgaactgagcccggcgcaaatcagcgaactgatgcacgtctccgacaagatcggcggcctcaacgccgcgcgcttcggcagctggaccccggccttcactccggccaacgccaagcaggcgctgctggcgttcaagggcgacgtgtacaccggcctgaatgccgaaaccctgagcgaagccgatttcgactacgcccagcagcatctgcgcatgctttccggcctgtacggcctgctgcgcccgctggacctgatgcagccctatcgcctggaaatgggcactaagctggccaacgcccgcggcaaggacctgtacgccttctggggcacgcgcatcagcgaatggctcaacgaagccctggccgaacagggcgacgacctgctgctcaacctggcttccaacgaatacttctcggcggtcaagcgcacggccctgaacgcccggatcatcaataccgagttcaaggacctgaagaacggccagtacaagatcatcagcttctacgccaagaaggcccggggcatgatgagccgcttcgtcatagaagaacgcatcaacgacccggcggccctcaagcagttcgatgtccagggttaccgctacagcgccgaacaatcgaaacccgataatctggttttcctgcgcgatcacgcaccggaataacgcacgcggtcgatgcactggtttcgcgcaaacgagtgcgtcgacgagcggtcactttcctctttgactcccgccaaaacgccaaacaattggcgccaaaatattttcttctgaatttataacttttgtttcactcgacagaggtcatttttttcagtagtggcacacaaattttttatcggtagtggcataaaaatatccccgcgctttaactccccagaactaaaggctgaaatggtaagtgctatcaatatgaaagcagtgccatcttttgcaatatttcaagaaatttcagaaaacaggatcagcggtctggaactatgtcctgaaccaccgctcataccaccggtaacgattctcaacgagtttgtaggagatgacttacatgggatccaacgacagtagcgaagttgtcatattaccctgacctactgctcaggaactcgaacttagggtcaatacacaggagataatgcaccattactatcccctacaaggccatggcatagcccgccttaaaacgcttcctggagcgtgtaactacctgattatcatgggcctgctcctataaatcaggattatcgccaacctcggagctgccttccagcaggaaggtcggcaacatttaagggcagcccctacaacaaggccaagttgcgcacaacttgagtgcacttatttagacactcggaacttagtctgcctgcactggatatctcaacgcctgttcgttgaacttccgagtgcgcaattaaagctggcaaacattaactccggccatctaatggcgtgaataacacagaggtaaatgcgatgcgcatcagcatatttggtttgggttacgtcggtgcagtatgtgccggttgcctgtctgcacggggccatgaggtcgttggcgtcgatgttgccaaggacaagatcgatatgatcaacgccggtaaatcgccgatcgttgaaccgggtctgggtgaacttctggcgcaaggtattcaaaccggtcgtctgcgcggaaccaccaacttcgccgaggcgattcgcgacaccgacttgtcgatgatctgtgtcggcacgccaagcaagaagaacggcgacctggaactcaactacatcgaggcggtatgccgcgaaatcggttttgtcctgcgtgacaagacctcccgccacaccatcgtggtgcgcagtaccgtactgccgggcactgtcgccaacgtggtgatcccgatcctcgaagactgctccggcaagaaggccggcgtcgacttcggcgtcgcggtcaaccctgagttcctgcgtgaaagcaccgcgatcaaggactacgacttcccaccgatgaccgtgatcggcgaattcgacaaggcctcgggcgacgtcctgcaatcgctgtacgaagaactcgatgcaccgatcatccgcaaggacatcgctgtcgccgagatgatcaagtacacctgcaacgtgtggcacgccaccaaggtcaccttcgccaacgagatcggcaacatcgccaaggccgtcggcgtcgatggtcgtgaagtgatggacgtggtctgccaggacaagaccctcaacctgtcgcagtactacatgcgtccgggcttcgccttcggcggttcctgcctgcccaaggacgtgcgcgccctgaccttccgcgccggttccctggacgtcgaagcgccgctgctcaactcgctgatgcgcagtaacgagtcccaagtgcagaacgccttcgacatcgtctccagccacgacaagcgcaaagtcgccctgctcggcctgagcttcaaggccggtaccgacgatctgcgcgaaagcccgctggtggagctggcggaaatgctgatcggcaagggcttcgacctgagcatctacgacagcaacgtcgagtacgcccgcgtccacggtgccaacaaggactacatcgagtccaagatcccccacgtctcgtccctgctcaacgcggacttcgactcggtgatcgacaactccgacgtgatcatcctcggcaaccgcgacgagaagttccgcgccctggccgaagacgtgccgcacggcaagcaggtcatcgacctggtcgggttcatgtccaaggccagcagcgcgagtggccggaccgaaggtatctgctggtaaccagcggtatcgggggcagtcccccgttcctgtagccgctgccgcaggctgcgatcgaacccgaagggtcgcgacgtacctgcaaccgccggaggtcctgcggacctatcgcagcctccggcaacggctacaggaatgtgccccctttggcttttttgcctgccttaaccccatcgggccaccccacaggctcgcccgagatcgagacggatgcagattatgcacaggctaaagcacggcctacttcaggccgcaggttggctgtttttcttgagtttactgatgggcctcgccctggcgttgcccgcgtccacattcgactccgaatcgaaggacttcatcttcctgattggcgccgtgggtatctggcgctactcgatgggtgccacgcatttcgtgcgcggcatgctgtttctctacgtggtctacccgcacctgcgccgcaaggtccgcaagctgggcaaggccgccgatccgtcccacgtgtacctgatggtcaccagcttccggatcgacgccctgaccaccgcccaggtctatggctcggtgatccgtgaagccatcgactgcggcttccctaccaccgtggtctgctcgatcgtggaaatgtccgacgagctgctggtgaagagcctctgggcccgcatgaacccgccggcccacgtcaagctcgacttcgtgcgcatccccggcaccggcaagcgcgacggcctggccttcggtttccgcgccatctcccgccacctgccggacgaccgcgccgtggtagcggtgatcgacggcgacaccgtgctcggcgaaggcgtggtgcgcaagaccgtgccctggttccagctgttcggcaacgtcggcggcctgaccaccaacgagttctgcgaagtgcgcggcggctacatcatgagcgagtggcacaagctgcgcttcgcccagcgccacatcaacatgtgctccatggccttgtccaagcgcgtgctgaccatgaccggacgcatgtcggtgttccgcgccagcgtggtcaccaacccggacttcatcgccgacgtggaaagcgactcgctgcaacactggcgcctgggccgcttcaagttcctcaccggcgacgacaagtccagctggttcagcctgatgcgcctgggctacgacaccttctacgtgcccgatgcggcgatcaacaccgtggagcacccgccggagaagagtttcatcaaggccagccgcaagctgatgttccgctggtacggcaacaacctgcggcagaactcccgggccctgggcctgggcctcaagcgcctgggcctgttcaccagcgtggtgctgttcgaccagcgcgtgtcgatgtggacctccctgctcggcctgaccgtggccctgatcgccagcttcaagtacggcaccgccttcatcctggtgtacctgctgtggatcggtatcacccgcctgctgctgaccctgctgctgtcctgttcggggcacaggatcggcccggcctaccctttgatcctctattacaaccagatcgtcggggccctggtgaagatctacgtgttcttccgcctcgaccaacagtcctggacccgccaaccgactgctctgtcccgtgacctcgccagctttcaacgttggttcaacacctggtcgtctcggaccatgaccttctccgccggcagcattttcgtcgccgcgctgctgctgatggtctgacccgccttgcctgaattaactaggaaatcgcccttatgaacaccgccgtgaacgtcaatgtagtgcatgaatccgaagcccaacgccaacacgcccgggtcaagatcccggccaagctgcgcttcttcggccccgaccggaccccggtcgaagcgcgggtcatcgacctctcggccggcggcctgagcttcaactgcgggcagttgccgatcaaggtcggcgacgtgcacaagggtcgcctgcagttcgtcatcgacaacctcgggctggccatggacgtggagttgcaggtgcgctccgtggatcgccagagcggccgggtcggctgccagttccagaacctcgagccccaggatatctcgaccctgcgccagctgatcacctcgcacctggccggcgacatcgtgaccatgggcgacgtgctcgccaccctgcagcgcgacaacttcaccaaggcgcgcaaaaacaaggacgccggccacggcatgagcgccctgggccgcctgcgcgcggtgaccttcagcgccgggatcttcgtcgtcggcctggcggccttcggcttcatcctcaagtcggtgtacggcatgtacttcgtcagccacgcccaggccggcctggtcagcgcgccggggatgaacgtcaccatgccgcgcgacggcaccgtgcagagcctgatccaggccgacggcgtggccgccaagggcgccccgctggcgaccttcagcaccagcatgctcgacgtgctcaagggccacctgaacgaagaccaactgcaaccggccaaggtcgaggagctgttcggcaagcagatgaccggcaccctgacctcgccctgcgactgcaccgtggcccagcagatggttgccgacggccagtacgccagcaagggcgacgtgatcttccagctggtcccgcgtaacagccaggccaacgtcgaagcgcgcttctcctaccgccagttcgccgacgtgcgtccgggcaccaaggtcagcttccagatcgccggcgaagacgaggtgcgcagcggcaccatcgtcagcagcaccagcctcaacggcagcgacctgtcctcggacattcgcgtacagatcaagcccgacgccccgctgagcagcaccttcgccggccgcccggtggaagtcagcagcgaccgcggcccgtccgtgaactggctgatcgacaaagccatggctgccggtctctaaccatgactattcataccccactcccgatgacgaaaacggcccctgtagccgctgccgcaggctgcgatcgagtgcaacgcactcgtgaaggggatgaatgcggtctggcgaacacagcgcgccgtccggaacccgtccgctacgcggccgatcgcagcctgcggcagcggctacagggttcggcattgctgttgcctctggtgaccgccatggccctggccggttgcgccggcctgcccgaccagcgcctggccaacgaagccctgaagcgcggcgacaccgtgctcgcggagcagaactaccggcagctggcggacctgggctacagcgacgcccaggtcggcctggccgatatccagatggaaacccgcgacccggcgaagatcaagcaagccgaggcgacctaccgcgccgcggccgacacttcgccgcgggcccaggcgcgcctgggtcgcctgctggtggccaagcccggctccaccgaagccgagcaccacgaagccgaaggcctgttgaaaaaggccttcgccaatggcgaaggcaacaccctgatcccgctggcgatgctctacctgcaatatccgcagagcttccccaaggtcaacgcccagcagcagatcagccaatggcgcagcgccggctacccggaagccggcctggcccaggtgctgctgtaccgcacccagggtacctacgaccagcacctggccgaggtggaaaccatctgcaaggcggcgctgaacgtcaccgatatctgctacgtcgaactggccaccgtgtaccagaaacgcggccagccggagcaacaggccgagctgctcaaacagctgcaggccggccacgcccgcggcgtcatcagcgcgcaacgggtcgacagcgtggcccgggtgctgggcgacgccagcctgggcaagaccgacgagaaaaccgcgcaggcgctgctggagccgatcgctcccggctacccggcctcctgggtcaccctggcgcaactgctctacgacttccctgaactcggcgacgtcgacaagatgatgcagtacctggacaacggtcgcgccgccgaccagccccgcgccgaactgctgctgggcaagctctactacgaaggcaagatggtcccggccgacgccaaggtcgccgaagaacacttcaagaaggcccagggcaaggaagtcgccgctgattactacctcggccagatctaccgccgcggctacctgggccaggtctatccgcaaaaagccctggaccacctgctgaccgccgcgcgcaacggccagaacagcgccgatttcgccattgcccaactgttctcccagggcaagggcaccaagcccgacccgctcaacgcctatgtcttcagccagctggccaagacccaggacaccccgcaagccaacgagcttgcgcaacaactcgaagcccaactgccgccaggccaacgtgccgaggcccaacgcctgctgcaacaggagcaggccgtacgtggcgccttgagccagaacacgttggaactgcacgcgctgcaggaagaagacggtgaggaatccctatgaaactcaagcccattccccaggccgatatcgttcgcgacgacgccgcccctgtagccgctgccgcaggctgcgatcggccgcgtagcggacgtcgtccaggcgcccgagatctttcagccgcaccgcacgcgcaggttttgcggctgctgcgcagccaatcgcagcctgcggcagcggctacgggaaaactgttcagcctgtcgaaactgggtgtggccctgggttttgccctgctctggtccaacccgacgctggcggccgtcaccgacaccaagaacttcggcctggaagtgaagatcaccggccaatccgaagacgaccgtgacctcggcaccctgggcggcggcgacgtcaacggcgtcggcctcgacctgcggccctgggtctacggcgaaagcggcaactggagcgcctacgccatgggccaggcggtgacctccaccgatatcatcgagaccgacaccctgcagcagtccgacggcgccagcaccgaaagcagcaacaacagcgaccgcaagagcaagaagaactacctggcgatgcgcgagttctggatcggctacagcggcctcaccccctacccgggcgagcagttgaagttcggtcgccagcgcctgcgcaacgacgacggccaatggcgcgacaccaacatcgaagccctgaactggaccttcgacaccaccctgctgcgtgccaacgtcggcatcgccgagcgcttcagcgaataccgcaccgacctcaaggagctggcgccggaagacaaggatcgcctgcacgtctacggcgatgtggcctaccagtggaccccggggcattgggccggcgtgcgcgcgcaccacagccacgacgacggcaagctcgactacccggttccgggcgaagccaccgactctctggacaagcgccagaacggcgacctgacctggctcggcctggaagccaacagcgacgcctacaactggcgcaacaccaacaccgtcaactactgggcgagcatcaccggcatgagcggcgaccgcgacaaggtcaacgcgctgaacgccgacggcacccgcccggcccaggccaagagcggcgagagcctcgacggctgggccaccgacctcggcgtgcgcctgcgcctggacccgaaatggcaggtcggcgcggcctacgcccgcgccagcggcgactacgaacagaacggcctggaaagcaaccgctcgaactacaccgggacccgctcgcgggtgcaccgtttcggcgaagccttccgcggcgaaatgaacaacatgcagaccgccaccctgttcggttcctggatgctcgccgacgaatacgacgccagcctgatctaccacaagttctggcgcgtggacggcaacaagccggtgggcagcaacggtatcaacgccgtggaaaacaactacgacgacgccaccggcgccctgctctccagctcgtccctgccgctgcgcgatggcgagaaagaccttggccaggaagtggacctggtggtcaccaagtacttcaagcaaggcctgctgccggccgcgctcagccagtcgatcgacgagccttcggcgctggtgcgctttcgtggcggcgtgttcaagccgggcgatgcctatggcaagaacgtcgactcgtacatgcaccgcgcctttgtcgacgtgatctggcgcttctgatgcgagtcgccaagggagtgcctgagatgaacagcccgatgaacagcccagcgatcagaggctcgatcagcctgttggccggcgccatgctgctggccagcagcgccgccttcgccaacgtcgaaccggccccggccgccacgcccggcaagcagccgaccgtggccaaggagctgcaacaggccaagacctacaccgtcagcagcgcgcccaccgcgccgctgaacctggccaagccggccctgcccgacctctccggctacaccgccgaagcggcggcggcgaagatcgtgcgcagcaagcccggcaagatcagcgtgcgccgcatgatgcaggaagacgcgctgaaggactttatcggcggtgacaacaagatggccgaatgggtggtgcgccagcacggcatcccccaggcgatctttatcgacgacggttacgtcaacctcaaggagctggcgaagaagctgcccaagcagtacatcagcgaaacctcgccgggcgtgtacctggcgcggctgccgatcgtggtcgggcgcaagggcatcctggaaatcgaccagcagacccaggaactgcgcctgtcccaggaaggcggttcgttcctggtcaacgacggccagctgttcgtgcgcgacaccaaggtcaccggctggcgcgagaaggacaacggcccggcgaccttcaactcgcccaaggaattccgtccgttcctgctggcctggggcggcaccgagacctacatcgtcaacagcaagatggccagcttcggctacgccaacagtaagtcctacggcgtgagtatttcccagtacacgccgaacatggccaaggtgctcaagcgccccgaacccaccggctggatcatcggctcggagttctcggacatgtggtacggcttctactgctacgagacccgcgacttcgtggtcaagggcaacacctacaaggacaacatcgtctacggcatcgacccccacgaccgttcgcaccggctgatcatcgccgacaacaccgtctacgggaccaagaagaagcacgggatcatcatttcccgggaagtgaacgacagcttcatcttcaacaaccgcagctacgagaacaaactttcgggcctggtgatcgaccgtaacagcgtgaacaacctgatcgccgacaacgagatctaccgcaaccacaccgacggcatcaccctctacgagagtgccgacaacctgctgtggggcaacaaagtgatcagcaaccggcgccacggcatccgcattcgtaacagcgtgaacatccgcctgtacgagaacgtcgccatggccaacggcctgaccggcgtctacggccacatcaaggacctctccgacaccgaccgcgacatcaagctcgacccgttcgacgcccaggtgtcgctgatcgtggtcggcggcgagctggccgccaatggcagcggcccgatgtccatcgactcgccgttgagcgtcgagctgtaccgtgtgtccatgctcgccccgaccaagagcagcggcatcagcttctcggggatcctcggcgagcgccaggacgaaattcttgacctgctggtgcgccagcagaaagccgtgctgatcgaccctgtcgaacgccagaccgaaatgcgcgattgaggatgactgtcatgcgcccacacctgatcaaactcttgagcctctcggcattgaccgcgggcattctcgccgccagtaacagcgctcgcgccgatgaaacccaggcaccgaagttcaccgccgagccctgctgcaacctgtgcccggcggcccatgacgcgaagaactacaccacccgctaccagcagaacttcaccaccctggtgcaagcccagggcgactggctgttccgtacccaggaagacctgcgcaccgaattcaacaccacgccggaaggttatcgccgcctgcaacagctgcacgacgccttcaagagcaagggcgtggagctggtgctggtctaccagccgacccgtggcctggtgaaccgcaacaagctcaacccgcaggagaaggccagcttcgactacgacaaggccctgaaaaactaccagggcatgctcggccgtttcgcccagatgggctacgtggtgccggacctgtcgccgctgaccaacgagcaactgccggagaccctgccggcccacgacttctacttccgcggcgaccagcactggaccccgtacggcgcccagcgcacagcgaagatcgtggcgcagaaggtcaagcagttgccggccttcgccgacattcccaagcgtgagttcgagacccacaagtccgggcgcatgggcaagaccggcaccctgcacaacatggccggccagctctgcggcaccagctacgcgatccagtacatggaccagttcaccaccgaacccaagggcgaagccggcgacggcgacctgttcggcgattccggcaacccggaaatcaccctggtgggcaccagccacagcggcaagaactacaacttcgccggcttcctgcaggaagagatcggcgccgacattctcaacgtcgccttccctggcggtggcttcgaaggctccatgctgcagtacctgggcagcgaggaattccagaccaagccaccgaagatcctgatctgggaattctcgccgctgtaccgcctggaccaggaaaccatctaccggcagatgatggccctgctcgacaacggttgcgaaggcaagccggcgcaaatgagcgccagcgccaccctcaagcccggcaagaacgagctgatggtcaacagcaagaacatggacctgcgcaacagcagccaccaggtcgatatccgcttcgccgacacctcggtgaaaaccctgcaagccaccctctggtacatgaacgggcgccacgaggacatcaagatcgacaaaccggaaacatccgacaccgacgggcgtttcgcctttgaactgcgcaccgacgaagactgggcctcgcaaaacctgctggcggtcgaagtccagggtccggaagccggcgccgcggcacagaaagtcgaagcgaaaatttgcaaacgcaacgtattcccggacgccggtcaacgcaccgcgcaaatcgggcaatgaggttcctatgcaaagcaaaacgctgaaacagttactggcaccgagcctgttgagcctggcgatgttcgcaggcgcaacccaggccgcggccccactgcgcccgccccagggttattacgcgccggtggataaattcaagagcggcgaccacagcgaaggctgcgacgccatgcccgcgccttacaccggctcgctgcaatttcgcagcaagtacgaagggtcggacaaggctcgcgcgaccctcaacgtgcaatcggaaaaggcctttcgcgacagcaccgccgacatcaccaagatcgagcgcggcaccagcaagcgggtgatgcagttcatgcgcgacggccgtccggaacaattggactgcaccctgagctggctgagcgcctgggcccaggccgacgcgttgatgtccaaggacttcaaccacaccggcaagtccatgcgcaaatgggccctgggcagcatggcttcggcctacctgcgcctgaagttctccgactcccatccgctggacactcaccagcagcaggcgcagcagatcgaggcctggttcagcaagatggccgaccaggtggtcagcgactgggacaacctgccgctggagcagaccaacaaccactcgtactgggccgcctggtcggtgatggccaccgccgtggcgaccaaccgccgcgacctgttcgactgggccgtgaaggaatacaaggtcggcgcccaccaggtcgacgccgacggcttcctgcccaacgaactcaagcgccagcaacgcgccctggcctatcacaactacgccctgccgccgctggcgatgatcgccagcttcgcccaggtcaacggcgtcgacctgcgccaggaaaacaacggcgccctgaaacgcctgggcgagcgggtgctggccggggtgaaagacccggatgagttcgaggaaaagaacggcaaggaacaggacatgaccgacctcaaggtcgactcgaaattcgcctggctcgaacccttctgcagcctctacacctgtgccccggatgtactggagcgcaagcacaagatgcaaccgttcaagaccttccgcctgggtggcgacctgaccaaggtctacgacccctcgcatgagaagggcaacaaaggctcgtaagcgacacctgtagccgctgccgaaggctgcgatcgactgcgaagcggtcgtgcttttgaggccgagggaaggcccttcgggccttatcgcagcctacggcagcggctacagggaatgatgtgaatgcaatacgccgcccccggtttttcacgggggggtttgggggggctctggccctttactgttggtcaaacatggagagatcgggatggttttctcatccaatgtgttcctgttcctgttcttgccgatctttctcggcttgtactacctgagcgggcaacgctatcgcaacctgctgctgctgatcgccagctacgtgttctatgcctggtggcgggtggacttcctggcgctgttcgccggcgtcaccctgtggaactactggatcggcctgaaagtcggcgccgccggtgtacgcaccaagccggcccagcgctggctgctgctcggcgtggcggtcgacctgtgcatcctcggctacttcaagtacgccaactttggcgtggacagcatcaacgcgatcatgacctcgttcggtcttgagccgttcatcctgacccacgtgctgttgccgatcggtatctcgttctacatcttcgagtccatcagctacatcatcgacgtctaccgcggcgacaccccggccacccgcaacctgatcgacttcgcggcgttcgtggcgatcttcccgcacctgatcgccggccccgtgctgcgtttccgcgacctggccgaccagttcaacaaccgcacccacaccctggacaagttctccgaaggctgcacgcgcttcatgcagggcttcatcaagaaagtgttcatcgccgacaccctggcggtggtcgccgaccattgcttcgccctgcagaacccgaccacgggcgacgcctggctgggcgccctggcctacaccgcgcagctgtacttcgacttctccggctacagcgacatggccatcggcctgggtctgatgatgggttttcgcttcatggaaaacttcaagcagccctacatcagccagtcgatcaccgagttctggcggcgctggcacatcagcctgtccacctggctgcgcgactacctgtacatcaccctgggcggcaaccgcaaaggcacgctgatgacctatcgcaacctgttcctgaccatgctgctcggtggcctgtggcacggcgcgaacatcacctacgtggtctggggcgcctggcacggcatgtggctggcgatcgagaagatgctcggcatcaacacttcgccgcgcagcctgaacccgatccgctgggcgctgaccttcctgctggtggtgatgggctgggtgatcttccgcgccgagaacctgcatgtcgccgggcgcatgtacggcgccatgttcagcttcggcgactggtcgctgtcggaactcaaccgcgccagcctcaccggcctgcaagtggcgaccctggtcgtggcctacgccaccctggcgttcttcggcctgcgtgacctgtatcgcaacccgacgccggtcaagagcaagcccgaaatcaacaccgaggccgacggtccggccaccgcccagccgggcctgatcaaggccgtaccgggggacaagccaggcagcatccaccagccgggctacaccgtgggcgtcgaagcccaggtccagccggcctactgggtcgccgactggccgcgttacgtgatgcgcgccctggtgctgctgctgttcatcgcttcgattctcaaactctcggcgcaaagcttctcgccgttcctttacttccagttctgagggatctgaccatgacccgctcattacgcgtcttctatatcgccctgttcctggtgaccctgatggtcctgggcctgtggtcggtgcgcagcttcttcggcttcagcaccagcaacgacgccaccgtgctcaacggtcgctgggccaaggccgtggaaacccactacgacgacgagttcccgatcaagcgcctgggcaccaacctgtgggcggccctggacttcaagctgttcaacgaaggtcgtccgggcgtggtgctcggccgcgaccagtggctgtacagcgatgaagagttccacccgatcgtcaacgaagaactcaacctgcaaggcaactacgcgctggtcgaaggcgtgcgccaggccctgaaagagaaaggcgtgaaactggtgatggcgatcgtgccggccaaggtgcgcctgtacccggaacacctgggcgacgtccagccggccagcatccacgccaacctctaccaggacttccacgcccgggtggcggccgacaagatcctcgcccccgacctgctgggcccgctgcaacaggccaagcagaacggccagcaagtgttcctgcgcaccgacacccactggaccccggccggcgccgaagtcgccgccaaccagttggccaaggcgatcgccgacaaggcaccgctgatgggccagccgcaacgcttcgtcaccgaagccgagcaaaccgtggtgcacaagggcgacctgcgcctgttcctgcccctggacccgctgttcgagaacctgatgccggccaaggagccgctgcagaaacgcgtgacccgtgccgccgacgatcagccggccgccgacgacgcgttgttcgccgacaacgaagtgccggtggccctggtgggcaccagctacagcgccaacccgaactggaacttcgtcggcgcgctcaagcaggccctgcacagcgacgtggtcagctacgccgaagacggccacggcccggtgttgccgatgctcagctacctgaaaagcgatgccttcaagaacagcccgccccaggtgctgatctgggagttccccgaacgatatctgccggtcaataacgaaatcggcgacgccgacccgcagtgggtcgcagagctcaaacaagccggcgcccgccaacagaacgtagctgcactcaacaaatccgagacgcccgatcgggcgcaaaactgaaagagaggtgacacccatgactttcactatcactccgcgtcgtctcgccaaggcaatcacactggctgccggcatgagcgtcctgtccctgcccgccttcgccggtggcgacgccgcgctgtacggcccgactgcgcccaaaggctcgtccttcgtgcgtatctacaacgccagcaaccaggaagtcagcgccaccgtcggcagcaccagcctcagcgacgtcgcgccgctggccagcagtgacttcagcttcatgcccggcggcgactacaccgccaaggtcggcagccagagcgtgccggtgaaactcgccgccgaccactattacaccctggtcaacaacgccagcggccagccgcaactgatcgaagaaccgccgttcaagaacaagcagaagtccctggtccgggtgcagaacctgagcgacaaggccctgaccctgaagaccgccgacggcaagaccgacgtggtccagtcggtggccgccaagggccgtggcgaacgtgaaatcaacccggtgaaagtcagcttcgcgctgtacgagggcgagaaaaaagtcagcgacctcaagccagtcgccctggagcgcggcgaagccgcggtgctctacgtcaccggcaacggcagcagcctgtcgccagtctgggtcaagcgcccggtctcgacccgctgatgaatcgatcgggcaggtgaaggccatttctgtagccgctggcgaagcctgcgatcggttgcgcagcaatcgtgaaaacggctcacgcggtctttcagcaagaccgtagcgcctgagtcacgaccgcttcgcgatcgttcgcagcctgacggcagcggctacagggatcggcatacaccgcccggcaagcaacaaaaacaagagagtgaaacgacagaacgcagtagctctaacccaaacgatttttgaaggagtaacaacatgattccggtgatcttgtcaggtggtagtggctcacgtctttggccgctttcgcgtaagcaattccccaagcagttcctcgccctgaccggcgaacacaccttgttccagcaaaccctcgagcgcctggtgttcgaaggcatggacacgccgatcgtggtctgcaacaaggaccaccgtttcatcgtcaacgagcagttggcggcgcgcaaactcgaagcccagcgcatcctgatggagccgttcggccgcaacaccgcgccggccgtggccctgaccgcgatgatgctggtcaacgaaggacgtgacgagctgatgctggtgctaccggccgaccacgtgctggaagaccagaaagccctgcaacgcgccctggccctggccaccgtggccgccgagcgtggcgagatggtgctgttcggcgtaccggcgaccaagccggaaaccggttatggctacatcaagtcgaccaacgatgcgctgctgccggaaggcgtgagccgcgtctcgcacttcgtcgagaaacccgacgtcaagcgcgccgccgagttcgtcgaggccggcggctacttctggaacagcggcatgttcctgttccgcgccagccgcttcctcgaagaactgaaaaagcacgacccggacatctacgacacctgcctgctgaccctggaacgcagtgcccaggacgccgacaccgtggacgtcgacccggccaccttcgcctgctgcccggacaactccatcgactacgcggtgatggaaaagacccagcgcgcctgcgtggtgccgctgagcgccggctggagcgacgtgggctgctggtcgtcgctgtgggacgtgcatgaaaaggacgccaacggcaacgtcagcaagggcgacgtggtgatccaggacagccgcaactgcatgatccacggtaacggcaagctggtgtcggtgattggcctggaaaacatcgtggtcgtggaaaccaaggacgccatgatgatcgcccacaaggacaaggtccaaggcgtcaaacagatggtcaacaccctcaacgaacagggccgcagcgaaacccagaaccactgcgaggtctaccgtccgtggggctcctacgactcggtggacatgggcgggcgcttccaggtcaagcacatctcggtcaagccgggcgcgtgcctgtccctgcagatgcaccaccaccgcgccgaacactggatcgtggtcagcggcaccgccgaagtcacctgcgacgagaacgtgttcctgctcaccgaaaaccagtccacctacatcccgatcgcctcggtgcaccgcctgcgcaacccgggcaagatcccgctggagatcatcgaagtgcaatcgggcagctacctgggcgaagacgacatcgaacgtttcgaagacatctacggccgctccaccccggtggaacgcggtatctcggtgaaaaccatcgcccagtaatcacagcgacaagtttcaagcggcaagctgcaagtaaaagcagggagtcgttgccagcaagtccttgccccccgtccgaccgactgcgtcccctatccgcagctggttgggcgggggattttttatgtccgcgcgcctgaacgaggacctcctgtagccgctgccgcaggctccgataaggccgaaggccttccagcgatctcatgaccctgcgcccgcttcgcggtcgatcgcagcctgcggcagcggctacagtcgtttcgccaattcctacccgacatttcgaaaacaccgcagggcgtttcagatagctctcaacgactccatccataccgctcattagtgtttcgcaaggctagaacacacagcgaaaacagcgatggctgagcaaccctccggcaacaaatacaccaccgattcgcgcggcgaaccgacaccgatgccgcgcgtactgcgcccggccaacccgaatccaccgctgccgggcgcacgtacaaagaacacctcgatactggccacgcctcaaggcctcgacactcctgcgaaaccctcacaggtccaaccctctacgcctgtcgccccaggcttctacatcgtgccccggagcatgccgccgagcgagttgcagcgccgcctgttcgacagcccctcatccgacgtcctggccaaatacctgtccctcaatccgggcctgggcgatacggtcaaggccggcagcctgatcgtgctcagcgatccggccaaccacgcctgcacctacgaggaagcgcaactcatgcaggccgccgaacaggttaagatcgccctcgaaccgctgacgcccgacgaaaccgactttatggtccgccatcaggccgagatcgccggctttaccggccaggcctcgacctggctgggcatcggcaccgcgacgatgggcaaacacctggacaaactgcgcgagaccctgcacgacatggaacgtctgcatcaagacagctaccgccaacacggccacctcaaatccccagagttcttcgcccggcgccagcaattgctcaggcaactggacgcccaactgctgaactccacccgcctgcgcggctacaccaccctgggcgaccaccccaagctgaaaaccgccctcggcctctccagccgcagcctggtccatcaatgggacaaggccggtgggcccgggcagataccgggctatgtcgcccacgtgaaatcggtcagccgcgcggcgaagtacatgcagatgggtgggtatgtagggattgcgctgggtggggtttcgtcggtgttgaaggttcaggaggtttgtcaggcgggttcgggggatgggagttgcaagaaggttatgtttactgaaacgggcaacttcacaggttcaacaatgggaggaagcctgggagcttatgtcgggtacgccagtacttccatctgtgcggcaatcggagcgtctaccggagtcggtggggttatctgtgcagcgctaatcgtaggtaccagctcatgggtaggctcaacagcaggtggcgctacaggaaaagtctttggagaagtgctttatgaaatggacgtccaatgatctataaattccctcccctgataatcctgattctgactggaggcttgcttctgcttgccctcatcagtctcctcttcagctactacatgagtcgacgctacctcgacgggatgctgggggcgctaaaggggagtaactatttcgcaggctggacaacctacctacctcatctgggatggcatcctcgctatctgatgttcgcgaaactcagaggtatgatgttctggcctgggccgggaatacgcaggggaataatttccccagacgatgtgcgcaactttccgccgcagtacaagcgccttttaaaaacacagaacgtgctcgatggcgtgattatcgtgtggggggcgtttgtgtacctgctgataaagctgtagtcactcatctgcgaccactgatcagtgcaccttcccaactgtccatggaaagcatttatgcatgcacaagatttttgcgaactgacatcgccatgacagggcaacagttctggcattcctggctcaccctcatccttttgttatgtccatttctgctggccgtaataaacctctcgctcagctactacctgagccgccgctaccttaaagagatgctggaggccctacggcgaagccagcacttttatcgctggaccgacagccttctccacgagggatggttcacgcattttgtaatgctcgccgccgttcgaggatcgacgctttggcccggccctgcggttcgcagaggctttctttcctcggaagacatagacaacttccctccccatctgcaacgtctgctgaccatcagaaactggatggatgttgtgcttctggtctggggttcgatcatgtatacgctgttgaaactgactaagcactgacagatggcagaacaacaattctggagttcctggctcgcttttggacttttggcatgtccgattctgttatgcgctgtaagtctcgcgtacagctactatctgagccgacgccatctgagggaaatgttggaggccctacagcggagtaaatacttctatcgatggactgaaaagcttcaatatcgtggatggttcgagcattttctgatgttcgccaacgtacgaggaatgatgttctgccccactcccgggttacgtagagggttactttcggcggaagatgtacacaactttccaccccggttcaaacgccttctgagcatacaaaacaggctggatggtgttctcttcgtctggtccacgattatgtatgagctgttgaagctcactggctagagcttccccaaatccctgtagccgctgccgagccctcgaggctgcgataagaccggaggtcctcctgcggtctcaaaatccggcgcccgcttcgcggtcgatcgcagccttcggcagcggctacagatggtagcgtcacgctacaaatatcgagttgaccacctattcatcgctccctatcctcgcgcctgtcacgactcattcgtgatcgggtttgacggctcggttgttttctcaggaacgcagttttttcaactctgttttcttttggagccttccatgaccgaccgcatcgccctcaccagtaacgaatcctccacccccaccctgttcatcgacacccgcgcgcccttggacgaactccatgccagcgccgcctaccgcatcctcgcagtgacccagctgatggaaagcctgagccacatggacactcgcgacgccgatgccacagacctcacgcaaatcgcccatgccagcgccatcttgctgcgtgacggttgcgacctgctggacgtgcttggccggcgtattcgtggcagccagtacttgagctgacgagcacttcaatccctgtagccgctgccgagcctgcgaggctgcgataggaccgaaggtcctccagcggtttcaaaatccctgcgcccccttcggggtcgatcgcagcctcgcaggctcggcagcggctacaggagttagcgtcgaccggtaggtcgcgcatggcgcagctttggcttttgatcttgatccacccgccccatcgggaggccgagtggaggtgttcatcaggggacaggcgcgcagcgcccctcgacgtagtcgaggacatcgtatggaggtcgaagcgaagccgaccggagtcgatgccccctgatggacgccggagcgagggaacctgagcgcagcgaaggccgtacgcaggggcaagcgttttttggttactttttgctgggccggcattccggcgtttgaaaaaaagtgacccgccgtaagggcggaaccgccagcagtcgtgaccgcagaaacggatatgtactccgtccaacatcaccaccgccatcgcgggcaatcgagcgtcgaccggccgctcctacagaagcagccgcagcccaccacaaccatggccaatcccacctacgcttaggtaggatgactgctctatttcccccgaggttctcctcatgttcatcggcgttctgctggttatcacctggctgatcctgctggtccgttaccccgccaaggccttgccggtgtccatggccgccgctgtcgggctgggcctggtggcggtgtgggtggtctggctggacaaccgcgaagcccagcaactggcgcgcctggaattgcgcatcagctatgcccccgagcattgcccggcggatcgcccgctgctgctgaagatgaacaacggcaacgatgtgccgctgaccgaactgcgctggcgcgtcgccgcctacgccccgggcgacactgtgaacctggccgacaaccagtacagcgccccgcgttatcgcggccccggcgagttgcaggccggcgccaactgggaagactgcctgcccctgccgccgctgcgtcccggctaccgcccgcaaaccctggagtttcgcgccgaacgcttgcagggcagtttctccgactgattccccccttccctctttttgtacaaggaccgcgccatgcccgttgcgctgatcaccggttgttccagcggcatcggccgcgccctggcggatgctttcaaggccgccggtttcaccgtcctgcccaccgcccgcagggccgaggacgtagccatgctgcaagccgcgggttttgacgcggtgcaactggacgtcaacgacggcccggcgctcaccgccctgggcgagcgcatcaaccagcaatatggcggcctcgacctgctgatcaacaacgccggttatggcgccatgggcccgctgctcgatggcggtgtcgaggccatgcaacgacagttcgaaaccaatgtgttcgccctggtcggcgtgacccgggccatgttcccggtgctgcgccgcagccgcgggctggtagtgaatatcggcagtgtgtcgggcgtcctggtgacgccttttgccggtgcctactgcgcctccaaggcggcggtgcatgccttgagcgatgcgctgcgcatggagctggcgccgttcggcatccgggtgatggaggtccagcccggggctatcgcttcgagctttgccaagaatgccgggcaccaagccgaacagctgttgaccgaacgatcgccctggtggccgttgcgcgaaggcatccgcgcacgggccagggcctcccaggaccacccgacacccaccggcgaatttgccgccaggctgctcagggccgtgcagcaggacaaaccaccgcgcctggttcggatcggtaatggcagccgggcgttgcccttgatggccagtctgttgcccaaggggttgctggagaaggcgctgatgaagcgttttggcctgggcgcaaaactgtaacggccaatcaccggccgcggaacgtcgcgcggccgttcccacgggttccagaaaacgtcttttagtcgcctaggttgtaccctcccccaatcccagtagaatgcgcgcactcgaggctcccagggcctcgatcaggccgcatggatcgctggcgaaccgctgaaactccccctctcctttccatgctcgccgtcactcaatcgtcgatcagggaatatccattgaaacctcaacacttgctgccgctggtactggccaccgcgcttatcggctgcacaccgtcgccagacgaggagctgaacgccaccctgccccagctcagcctcaaggagctgttgccgccggccgtcgccaacgagtactgcaaccccaagctggacagcgatctgctgtatggcatcggctaccagctgtacaacgacgataaacccgagcaggcgcgcagctgcctgatcatggccgcgcccacccacgaccgggccctgtgctacctggcgagcatcgcggaacaggacagcagcaaggacagcgccgagcgcgaccgcgaagccttcggctacatggcctattccgcagtgaagaatgactcctgcgccgagttcggcatgttccagaatttcacctacggcatgcgcgggcagaccccggacagcgacctgggcctgcgctggctggagcgttccgcgcgccatggcgacgcggacgcgcaacagaccctggtgcgcctgcacagcaacaagaacaacctgccgctggcctacagctgggccagggtcctcgatgacagcgcacagatcaacgccttgaaacaacggatgaacccgcagcaaatcagcgaaggcgaacaagacttcgagcaactgggcaagaaggtcaccagcaaggacgcggtgcgcaaggaagcccgcgaggaaaacatcgcggtgtactcggcgaacatccatatggaataccccgagaccttcaagggcctgtcggtggccgagcgtcatgccctcatggagcaggccgtggccacggtaagcgcccgtcccgagttcagcacccgtggccagctgtacgcttatgtgatcatcgcgcggcaggcgcaattgaagcaggccggcgtcgatgtgctgcagtacccgcagatcgtggaactgctcagcgataaagaactggaagtgagcgaggcggtgaagaaagccgacgtgatcctcggccaggccgccctgtaacagcgggaacaccgccggccgcgccgatgcccgtagaatgcccgcactccaatcgcaaggaagcggcacctcaagcacggaacggctgcatcccgcccctgctcatgccctcttggcgccctcccttttacgattgaacctcagggactctccattgaaatctcgtagcctgctgcccttggctatcttcactctgctgctgggctgcaatgcctcgtcaccggacaaaaaactcaataattccctgccggacttgagcctcgagcagatcctgcccaaggtcgaggccaaccagtactgcacgccggagatggacagcgaattgctgctcggcctcggcatccgactgatcaatgaggacgaggtgctgtatggcgcaggccgtaccttgctggcgagcaaggaaataaaaatggcccgcagctgcctgatcatggccgtcccccgctacaccacgagcttgtgcatcctgggcagcattgtcggcgccaggcaaaacgactacgacaaaagcgaagccttcaactatatcgcctacgccgccaagcacaatgaatcctgcgcggaagcaggcctgtacgacatctacagcgttggcaagctgggccatccaccgaacaaggaattggccatgggctggcttgagcgcgccgctcggcacggcgaccaggagtcgcaacaggacatggtgcgttggaacagcgaacaggacaatttcccggtggcctatgcctgggccagggtcctgaatgaggcaaaaacaatcgagaccgtgaagcgcaaaatgagccctcggcaaatggccgagggcgagcagcactacagccaactgctcagccaactcacccccgaaaaggatattgagcaggcgctgcgcaaggacatcatcgccctaagctcaggggatctttactacagccacccggaggtgttcgagggcatgtcccctatgcaacggcgtgctttcgtggcccagttagtggacatgcaggacctctacccgaagttccacacgcggggccaagtggtggcctacgccttggtttcccgccttgtgcaaagcactggaccggccgtggacctgtggcaggacccggcgctacatgccttgctgatcgacgatgacctgagcgtggaagacaccgtggccaaggccaaaaccatcctggccaagcgcaagcaatagcttgagaggctggcgctacttcttttgaagcgccgccgaggtgtcgcgtgcgcaaggcccaagagccctttgccgtggccaaacagatgctgcggtttcggttgtgccccctcgcaatcccagtagaatgcgcgctcttgagcgcttgcgctcaacacagcatggaatcgctggcatcgacactgaaagcacggaactgctcaagctccctcctctcccgtcctgtccctgcttcattccatgcgcctcttcattcaatcgcagatcagggaatatccattgaaactgttcaacgtgctgccaatggcattggttgtgttgctggccggctgtactaccgcatccgataaaaccgccgataaagaatcgtccctcaacgacacactgcccaagttgaccctgcaaaacgtattgccaactgtggccagcaacgaacagtgcaatgcacaaatggacagcgacattctgttcggcgtcggcttcctgctgtacgaaaaccaagagctcgatgctgcgaaaacctgcatggtgctggccgcgccgaaacaccctcgcgcgttctgctacctgtcgatgattgccggtcaggatgaaagcaaaaccgatgaacagcgcaataccgaatccttcaactacatggcttactcggcgctgcagaacgactggtgcgccgaatatggcctgtaccaggcctacaactacggcaataccagcgccaaacaggacacggccctggccctgcgctggctggagcgctcggcacggcacggctaccccgaagcgcaaaaggacctgatcgaaaagtacgaggaacaaggcaacctgagcgccgcctatgcctggacccgaatcatggccaaggccgatgacaccagcgcagccgacgccttgaaagccaggatgagcgccgcacagatcgccgacggtgaccagcgctacacccaactcaccggccaggtcaccagcaaacaagccctgtacgccgaagcgcgggaagaagacgtcggccgttactctgccgagatctatcaggactacccggacacctttaagggcctgtcgtccaccgagcgttacgactacgtcaagcaaagcatgttcaaggccatcgacctgccgttcgtcaagggtcgtggccatgtcctgagctacatcgtggtgaatcgccaggctcaactgaaaaagcccggcgtggacatcgcgcaggacaagaaaatcgtcgcggtgatgaaggacgatgaactgtccgtcgccgaaaccatcgagcaggcactgtcgatcgtcaacaaaacctaccgctaacctggcctgtggcgaggagcttgcctgctcgccacaacccggccttggccacaaatacccctgtgaggcgggctactccccatcctccttcaccaccaccgtgcaggtaatccccgccgccagcagcacgccttccggcacttcgtcgatatggatgcgcaccggcacgcgctgggccaggcgcacccagttgaaggtcgggttgacatcggcgatcagctcgcggctttccgggttgtcgcggtcgtagatgccgcgggaaatactctccacatggcccttgagcacctcgccgctcatcagctgcatctcggccttatcgccgacacgcacgtggggcagcttggtttcttcgaagaagccgtagacccagaacgagttcatgtcgaccaccgccatcttcggctcgccgatgcgcgcgtagtcgccacggtgcacgttgaggttggtcacatagccgtccaccgcggcgcgcacctgggtgcgtttgaggttgagctcggcggcctccagttgcgcctgggcctgctggtagtcggccagggccgagtcggcgatgttgctggcgtcgtcgcggttctccttggaaatcaccaggttgtccaggtcggcgcggcggtgggcgttgaccttgcgcatctcccaggtggcctttctcgaagccaccagcgactgcgcctgcttgaccgcgatctggtagtgctcggggtcgatctgcatcagcaggtcgccctttttcaccagctggttgtcgcgcaccggcacgtccaccacttcgccggtgacgtcggcggcgacgttgatgatgtcggcgcgcacccggccgtcgcgggtccacggcgtgttcatgtaatgcacccacagggtgcggccgatccacagggccagggccagcaccagcagggtcgcgagcaggctgaaaaactttttcatcaaaggactctcaacggtagacagtcagcgccatggcgccgaacagacagcagaacaggctcaggcgcagcagcgccgggtgccagaaaaaacggtacaggtcataacccgagatgaagcggtccagggcccaggccagggccgcggcaatgaagaacatcagggtcatggtcggcatgtacacgccgtggaaggcgatttcacgaggcatgtacacgccgtggaaggcgatttcacgaggcatgttcaagtccttggggcggggcctgtacggctggcggcgcggcataggcggccagcggcgattgcgggtcgagcaatgagctgcggatgaagtgcaggtagctcttcacccggcgcaagaccgaagtatcgaagtgcggggcgaagggttcgtcgctggactggacccggccgatcgcgtgatcgaccgcgaccagcgcgcgcgcaaggttgctctggcccggttgcaggagcagccgcaccagcgaacggcccatgacccggatcgcctggcgccacggctgggattcggcgtaagccgggtgcaccgggaggatcgcctgctccttgcgcagctcgatgatggcgtggcccacctccagcaccacgaacatccagcgcagcagctcacgctgcacctgtggctgccccgccgccaggccataggcctggtgcagcaggtcgcgggtgcggctttcgaagctcgacgccaggcccttgagcttgccgctgatggcgtacaccacctggccgcgcaggtcctgctccaggcggcgccacaaccagcggctgttgggcggcaggatgatcgccccggcggcggcgcagaccagcatgcccatgaccatggcgatgtagtcgttgatgaaggcgtaggggttgtagacggtcaggttgtccggcaccgaaccggtgctgaagaagatcagcagccccaggccgaccccggcgtactgcgggcgggaagcgaggaacgagccgagcacgatcaccggcgccagcatcacgcacagcaacggaaaaccgtcgatccaggggaacacgaagaacatctcgacgaagccgaccacggccccgatcaaagtgccgcaggccatctggaaggccatgcgtttcgggttcggcgtggcggccgagaggccgacggtggccgccgcgatcagggtcatggtggcgccgctgggccaggcggtggcgacccagtagctgccgagcacgatcaggatgaacgaggcgcgaatccccgaggcggccgaggccagccagttggtctgcggggtgaagggctcgtcccagcgctcgcgctcatggctgtgttcggccagggacgcgtgggtctgggcatagctgtgcagctcgtcgacgaagcgatagagcagctcataggcggtgtggaaatccagttgctcggcatcgctcggttcgtgttcctggaacagcgcgcgcatgctgcgcacccgcgccggcagctcggccttgtagctcgccagctgctcggccaggcgcgcggcatcggggctggtcagggcacggccggagaaaccgtccagcagttcggcgaggtcctgcaaccccggtttggtcgccgccagcacatactcggcggcactgttgcgcaagcgttcgagcaactggtgcagggcgttgaaacgggtggtgatgcccatgaactcactgttcaaacggctcaggcgaccattgcgccgacgcatgtgcgggtcttcgaacaccgtgacgctgcgcaggccttccaggcccaccgcctcggcaatgaaacgcacgttgccgctctcgaacgcgtcgcgctggctgcggccgcgcaaaccgtcggtgacgaacagggcgaacaccccgaagcgctggtacaaggcgttgcgcatcgccgcgctggcggtctgcggcaggatcgcggcgctgaccagggtcgagcagagaatccccagggagatttccagtacccgccataccgccgccataaaggccccgtccggatgggccagggccggcaaaccgaccatcgccgcggtatagccggccagcacgaagccgtaggcgcggaagttgcgataacgcgcggcgccggccgagcagatgccgacccagatcgccagcgaaccgaggaacagttcggtgttctgggcgaacagggcgatcagcgccaccatcaccgccgacccggccagggtgccgagaaaccgatagaagctcttggcgaacacctggccgctctgcggctgcatgacgatgaacacggtgatcatcgccgtgcgcggttgcggcagctccaggcgcatggccagccacagggtgaggaacgcggcggccaggaccttgaagatatagacccaggtcacgccgtcgctgcgtgcccagtcgaagaagccccggcgccattcaagggagtacagccagcgcaagggagcaggcaagggagtcatggggtcttactcggtgatcagcacttggtggtcggcttttaatggtcagcttttaatgatcgaagacagccagcgccgccggggtcttgctcggttgggtccggctgtcctcgggcacatcgcgccccgcctccaggccgccgcccagggccgtcaccagctcggcatgggcgctcaggcgcgcggcctggacctgctgctggatctgctgctggtggaacagcatgccctgggcattgagcacattgaggtagtcggtgaggccacgctggaaggcgaccatggcgatgtcgtaggtcttctgcgccgacgccaccgactcggcggcgaactcggcctgcttgtccatggactcgcggcggatcaactggtcggagatgttcttcagggcgttgaccagggtctggttgtaatgggccacggcgatgtcataaccggccgcggcctcgcccagctcggcgcgcaggcggccgccgtcgaagatcggcaggctgatggccgggccgacgttgtagttgagcttcttgccggtgagaaactccagcgccccgccgccggtggccatgtagccgaggctgcccaccaggtcgacgttgggatagaagccggcgtgggcgacatcgatgccgcgggcctgggccgccacctgccagcggctggcgaccacgtccgggcgctggccaagcagttcggcgggcagggccgacggcagtttcagcggcgcggccagggacaggctcggccgttgcaactgcgcgcccgcccccggccccttgccggccagggcggcgatctggttgcggcccagggcgatttcttcgtccagggcgtccagctggcgatgggtttccggcagcggagtctgcgcctggctgacttcgaagtgggtgccgatgccgccggccaggcgcttttgcgccagctcgagaatctgttcctgctgcttcagggtggcgaggacgatgtcgcgctgggcgtattgcagcgacagctggatataggcgcgcacgacattgttctgcagttccagctgggccaggcgcgcctcggcggcgctcatgtgcgccaggtccacggcacgctcgctggcattgctttcccggccccagaggtcgagggcgtagctgaagccgagtgcagcgttgttgtcccaggtggtgctattggccagttcgcccgggccatagaactgatcggtgggccagttgtggcgcttgagggtggcgtcgcccttgatctgcagcgactcggccgactcggcgatgccggccatggcacgcgcctggcgcacccgggcggcggccatggccatgctcgggctgccctgcacggccaggctcacccagtggttcagctgcgcatcgccataggcctgccaccattgggcggcgggccagcgggcgtcgcgcgcggcgctctggatcgcctcgtcggtggccagtgtattggccggtagtgccttgccctgcggggcaatgcccccggttccgatgcagccgctgattgctaacgataaagcccaaacactgagagtcttcagctctctgctgatgcgacgcggcactgctgcgaattcctgaaatagggagaaggcggatccctgtaggagcgagcttgctcgcgagacggcgtcactgacccaccgcattgcacgggttccggcagccggcccctacagatcggcgcaattctaggcggcgggctttacggcgataagctgggattcctgtgaatctttgttaccgttcgcgcgataatcccttggtgcaatagccaacaatctgttacttcgtgtcacaatttgccatctccccagagagcaccccatggacactttgcaaaacatgcgtgccttcagctgtgtcgccgaagccggcagcttcaccgccgccgccgtccagctcgacaccaccacggcgaatgtctcgcgcgcggtctccaatctggaggcccatctgcaaacccgcttgctcaaccgcaccactcgccgcatcgcgctcacggaggccggcaagcgctacctgctgcgctgcgagcagatcctggcctatgtcgaagaagccgaggccgaggccagcgacgcccacgcgcggccgtccgggcagttgaaagtgcacaccatgaccggcatcggccagcactatgtgatcgacgccatcgcccggtaccgcaagtcgcacccggacgtgaccttcgacctgaccctggccaaccgcgtgccggacctgctggacgagggttacgacgtgtccatcgtgctggccagcgaactgccggactcgggtttcgtctcccagcgcctgggcatcacctacagcatcgtctgcgcctcgccggcctacgtgaaagccaatggctgcccgaacagccccagcgacctgtcgaaccatgcctgcctgcgcctggtgagcccggtgatcgctctggacaagtggctgttcgacggtcccgagggccaggaaggggtcaccctcaacggctcgccgttcctggtgaactccgccgacgcgctgaaaaccgcgatcaccagcggcatgggcctgggcgtgctgccggtgtacgcggccatcgaaggcctgcgcaacggcaccctggtgcgggtcatgcccaagtaccgctcccaggagctgaacctgtacgccatctacccgtcgcgccagtacctggacgccaagattaagacctgggtcgagtacctgcgcaacaccctgccggagattctcgccgcccatcaggcggagctgacggcctatgaactgagcggcggcctcagcggcgtgcgcctggccccatgagccaagcccttcagggctttgtcatgcttatcccatccctgtagccgctgccgcaggctgcgataaggccgaaggccttcggcgatctcaagagcacgtctcctgaggagccgatcgcagccttcggcagcggctacattcccagaaccttctcgcccccacggcctgccgcagccgctacaaaaagcccgtggggaatgttagcttgcttggcattctcctctgcctgacgagctttcccgcgatgaaaaagaccgtacttgccttcagccgcatcaccccggacatgatcgagcgcctgcgccaggacttcgaggtgatagtgcccaaccccaagctgggcgatatcggcgcgcaattcaacgaagccctgccccacgcccacggcctgatcggcgtcggtcgcaagctgggccgtgcgcagctggagaacgccagccggctggaagtggtctccagcgtctcggtgggctacgacaactatgacctggcctacttcaacgaacgcgggatcatgctcaccaacaccccggacgtgctcaccgaaagcaccgccgacctggccttcgccctgctgatgagcagcgcccggcgtgtcgccgaactggacgcctggaccaaggccgggcaatggcaggccagcgtcggcgcgccgttgttcggttgcgatgtgcatggcaagaccctggggattgtcggcatgggtaacatcggcgcggccatcgcccgacgcgggcgcctgggcttcaacatgccggtgatctacagcggcaacagccgcaagcccgcgctggagcaggaactgggcgcgcagttccgcagcctcgagcagttgctggccgaagcggatttcgtctgcctggtggtgccgttgagcgaaaagaccaagcacctgatcagtcaccgcgaactggcgctgatgaagccaagcgcaatcctggtgaacatctcccgcggcccggtggtggatgagccggcgctgatcgaagccctgcagaacggcacgattcgcggtgccggcctggacgtctacgagaaggaaccgctggccgagtcgccgctgttccagctgaaaaacgccgtgaccctgccgcatatcggctcggccacccatgaaacccgcgacgccatggccaaccgcgccctggccaacctgcgcagtgccctgctcggcgaacgcccgcaggacctggtcaacccgcaggtgtggaagggctgataccactgcctatcaccacctgtggccgcctgtccgcctgcccccctgtagccgctgccgagcctgcgaggctgcgaaaaggtccgcaggaccttcagcgatagacctgcagaatcaggtcgcctggttttgcgacggctgcgccgccgttcgcagcctcgcaggcttggcagcggctacagatgcaaatccggatgcagatgcaggcacaagtctgggcttgcggaacaccagtacgttgcccagcatcaccaggaccagcccggtcagcgccggggcggtccactggtaaccttcggcaaaggccgagacattcagcgccaccaccgggaacagcaccgtgcagtaggccgcccgctccgggcccatgcggccgaccagggtcaggtaggcggtgaagccgatcaccgaccccgggatcaccagatacagcaaggagccgatgtagcgcgcgttccactccatatcgaaagggatgcccttgaccaggcagtagcccgccagcatcgccgcgccataggccatgccccaggcgttggtggtcagcggcctgaggccggctttctgttgcaggctggacagcatgttgcccgccgagaaacacagggtgcccaacagcgccaggcccaggccgagcagggtttgcgggctggcgctatggccggccagctccggccagaacagcaggcccagccccagcagccccaacgccccgcccagcagcacgttgcgggcgatcttctgggcaaagaacacccgggcattcagggcgttccacagggtcgccgtggaaaacaccaccgccaccaggccgctgggaatccactggctggcgtgcaggaagcacatgaagttgatacagaacaggcacagcccctgggccaggcagatcaggtgtccacggcggttcatcgcctgcagcttgcggctgagcagcagcatgacgaacagcaccagggacgccagggcgaagcgatagacgatggacaccggaatcgccaccacccccagttgccacttgagggcgatccaggtggtgccccagatcaggacggtgagcagataaagcgaaaggttcatggcgcgggactcctgtgcagggcaacccagtctcaggccattgcgtgcccgggcgcttgcataaacttgcgcttttatcggttgccgggctggcagcgcgccgcccacggagtaggatgcaaaacatcgtgtagccgctgccgacaggctgcgatcggctccgcaggagacgtgctcttgagatcgctgaaggccttcggccttatcgcagcctatcggcagcggctacagaatgccgttcaatttcagacctgaccgccatgcccgcactggaaaccctgcaagtctttcaagccctgaaccgctcgcccaatgctcgcctggagcacagcgccgagctcggtgacggcctggccgcggccttgtggagcaaccatcacgacgcccaggactacgaagcgccgagccatcacaccctgtcgtgctacatcgctggcggcaccgggacctttcgccgcggccagccggggaccaagggcggtccggacaagctgtgcatcctgcccgccgagcaccagtcagcctgggtgatcaacggcgggatccgcctggcccacctgtatttcagcccggaacaattcgccctgggctgcgtgaccctgctggaccgcgaaccccgcgagctgcaattgcaggaaaccaccttcctcgacgacccgcagcaggcccagcgttttcggcaactgatccggatgaactgggacgaacccggcgagcgcctgctgaccagcagcctggcccacgagatgctcagccacgccctgctgacccaggtcggccagcgccagggcctgcgcctcaagggcgggctggcggcgcaccagcgtcggcaactggtggagtacatcgacagccagttggccgaaccgatcagcctggggcaactggccgcgcgctgcgccttgtcggaataccacttcgcgcggatgttccgcgcaagcttcggcctgccgccccatcaatacctgctggcgcgacgcctgaagcatgcccgcgacctgctgcgcggcacccgcctgcccctgggcgagattgccctggcctgcggcttcgccagcgccagccacttcaccaaccgttttcgccaagccctgggcggaacgcccggggaatatcgccaggcgtttctgggctgagcgcaaccgtcagttacagcgcgtcgcctttatcgcgagcaagcttctcctacagaaaatgaacgctgcttctgtaggagcgaagcttgctcgcgatggcgatgtgtcaggcaaacccggccccagccttattgcagcagcacctgcgtcacccggtcttccagggccttgatctgcgccccgtcggcgcggtagttgttcgacagcatcaccagcaccaaccggcggccatcggccgcgcgcaagtaaccggacagcgacgacacgccctgcatcgagccggtcttggcgtgcaggttatccacagccccggtgccttgcaggcgataacgcagggtgccgccggtcatgcgctgggcgatcgccggccaccggcagcgccgcgtaccaggtggcgaaccagggctgcttgcgcgccaccagcagcaggtcgctgaggctctggctggaaatctggttgcgccgcgacagcccggaaccgtccacctgcaccagccccttcgggctcaggccctgacgtcgcaggaaagcctcgatggccgccaccccggcagcggcggtgccggcattggcggtcttgcggcccatggccttgagcagcacttcggacatgttgttgttcgacagcttgagcaagggtgtgatcaggcccgccagcggcatcgacgagtggctggccagcacccgggcggcgggcgccgtgggctggccgaggcgcacctggccctgcaccgtcacgccctgctcggccagcgcttgttggaacacgtccgccaccaggcgggtcggctcccacacgctgacccagttgcgccgcgactgccccggcggcaaggcgccactgaccagcagcagattgctgccatgctcacggccgacctgcaggctgtccgccctcccgacccggccctggttgcgcaggctcatcagccggttttccggactgacccgcaccgccagcggcgctcccggcaccgtcggtgcggttaccgcaaccagtacgctgccggcgtcgaagtcgtcgtttggggagatattgagggcggaaatctgcgccgcgtaatacaggctttcatcgtcgctggcccaatcgacgccgagtcgttgatcgtcgaaggcggtatcgtcgagcaccaggtcacccgcgacctgacgaatgccggtacgcgccaccgccgccgccagctcacggtagtccgcgacctgcatgctcgggtcgccggagccgcgcaggtagagattgccgtgcaggagctcgccctgttgcgcaccgtcgcccagcacctcggaggcgaaacggtagtcggggccgaggacgtccagcgcggcggcggtggtcagcagcttgaggctcgaagccgggatcaggcggctgtcggggttgtgctgatacaaggccgcaccgctctcggcatcgcgcaccgtcagcgataccgtggcgccctggagcgccgggtcggccaggacctgatccaggttggcggcgtaccgggcgccgggatggctggcgcaagccgccagcgacaaggccaggaacaatcccagcccgcgagtgtaaaaacgatgtactgaacccatgagaaaggtatttccttgatgacctcgaacccaccgccgacagccttgcggctgtggcgggcgcccagataacgattggcgaggggcgcgtgtcaacgaacaatcgcagccgacacctcaggccggacgttgcgcaacgctcattgcgccaacgcggccagcggactgaccagcagccccagcccggccgccagcagcgccaggcgtggttgatacggcagcaacagcaccagcgacaaggcgctgagcatcaaggccgcgcaccactgcaccaggccgaaagcccagccagccgccgcgatcgccgcccacagcgagccggccagcagcaaccagccgccgaggcgcaggccactgcggcgccgggccgtgggtttgtagcccaggagttcggcgtggtgacggtccatcgacaggcacaacccggcaaagcctgggtaacacaacagcagcgccaggagcattcagttcacctcggattcaagggcggcccgtcgcgagcgggcggcaacggcaggctgggcgacaggacgcgacatcttccaggccgcccaggccaggaacagccccgccgccagacaggtcaggtcgaacccggcccggacccagtcgccgtgcaccaggaaaccatccagcacatcgggcaccgtcagcgcatcgagtagcggcacactggccagcagcaacgccgccgtgcccaactgctcgacccaggccttgcgcccgcgacgcagcgcggcgtgcagcaggctcaggccccagacgataaagaagctgttcacttcccagtccgcccgctcggcaaagctcaccggcaataggcggttggcccagaagaaggcggcgacggccagcaccaggccggacatgctggcgatgttcagcacttccaccagccgcaactcgaagggcgtcacgccgctcttggcatgtttgagctggcgcttgccgagccagatcaccagcccggtaccgatcatcgcggtggcggccaggccgcagacaaagtacagccagcgcaacagcggcccggcgaagaggcccatgtgcagcccatagaaaccgcctcggatagcaacgatcggcgactgcggcggggcaacctgcagcagcttgccactgacgccgtcgaacgaaaccgcactgccaaaatcgcgaaccacctggtcgccaccgtggcgcatgacattcaccgaggcattggcatccccgggattgttcaccgtgatacgccccacgcggccgcccggccactgctcgcgggcctgctgcaacagcggttcgagctgcaccagcggcgccggccggcccgcggccggtgcgttgctggtggctggaaacgcctcattgaacagtgcccggctgtcttcgccgtaggtggccaggatgctcgccggcatgaccatcgacatgaagatcaccaggctgctgtaggtgatcatcagatggaacggcaataccagcacacccaccgcgttgtgcccgtcgagccaggagcgctggcccttgcgaggacggaaggtgaagaagtccttgaagattttcttgtggatgatgatgccgctgatcaaggcgacgaacatcagcatggccgccgcggtggacagccagcggccccagggatagggcatctgcaactggaaatggaagcggtagaagaattcgccgccgcgggtatcgcggacctgcagctcggcgccggtggccgggtccagcagtttctgggtgaaggcgccgcgctcgccgggcttgcccggaaattgccacatcaccgacaacaccggctcgcgggcgtcgggcaagttgatgaaccagcgcgaggcgccttgggcgtgctgctgcaagtagctctgggcgaggatcacgctggtctcgttgctgaccgagcgcgacggcacttcgggctgcatccaatggctgatttcatccttgaaataggccagggtgccagtcaggaaaatcgccagcagcagccagccgaataccagtccgacccaagtgtgcaaccaggccatggactggcgaaatccctccttcatgagaggttcatccaatacgccaacgcagaaatcgccgccaacaccagcgccggcagcagcaacccgaaccaggcctgccaggccgtgcggcaggcgaagcaccagagcaccgccaccaggtagaacaggaaggacgccatcatgccgccgaataccgcatcggcgcgggacacagggagcagcagagtcatgcaaatgctggacagcgccgccagcaggtaaccgccgaacaccgcggccagcacccgcgaagtcacggccagacgataggaaaaagggatcgcagcaactttgcttttcatgtttcgaccttgaaaccaggacagcccggcattggcaaatacctcacgcgggctcaagtcggcgcaatattaatgataaatattctcatgtgcaaaaaatcaccaatccaccgagggctcttccgtcggtccgggttgattgcccaatgccatgtcaggccactacaatgcgaacaattcttgttctcttaagcattttcatgctgccggagcgttcggcttggctcactcctctaccgtcgaagtcctctatcacgtccatcacagctggctgaacggctggttgcggcgccggctcggctgccccgacagcgccgccgacctggcccaggacactttcatgcgggtgctcagcgcccgggaaacgccgtcgatcgtcgagccacgggcgttcctcaccaccatcgccaaacgggtgctgtgcaaccactaccggcgccaggacctggaacgggcctacctcgacacgctggcgcagatgccggaactgctggtgccgtccgaggaggacaaagcgatcatcctgcagaccctgatggagctggaccagttgctcgacggtttgccgcgcctggtgaaacgcgcgttcctgctggcccaggtcgatggcctgaaacacggcgagatcgcccgcgaactggggatttccatcgccacggtcaagcgccacctgcacaaggcagccctgcgctgctacttcgccctatgaacgctgcactcccccgcccgccggacatcggcgcccaggtcgccgaacaggccgtgcactggctgctcgaaatgcaggaggggccgctcagcccgcgccagcaactggcctggcagcagtggcacgacgcccacagcgaacatcaacgggcctgggaacatatccagcgggtcaattcgcggctgcgcggcctgtcttcgcccctggcccatgccgcactcaatgcgccgaagtcctccagccggcgccaggcgctgaaactgctgctgatcctcggcgccggttccgccgcggcctggggcttgcgcgaacacaatccgctgaccccgctgatggccgactaccgcagcccggtgggccagcggcgcacgctgcaactgagcgacggcagccagctgcagctcaataccgacagcgcggtggacgtgagtttcgatggccagcaacggctgatccggctgttggccggggagatcctgctgaccgccgcggccgaccaccggccgctgctgatccagagcgcccagggcctgctgcgcccacaaagcgcacgcttgaacctgcgccagttcagccagcgcacccagctggcggtgttcgagggcaacgtcagcctcagcccgtcggattattcggcagcgccattgcaggtaagcaaggggcaacaattgagcttcacccgcagcgcctgggacaacccgcggccgctggacgccggcagcggcgcctggagcgagggcatgctggtggccgcccatatgcgcctggcggacttcctcgacgaattgggccgttaccgtcgcggccagctcaactgcgatccacgggtcgccgacctgctgatctccggcagttacccactggacgacagcgaacggatcctcgacctgctggaaatcagcctgccggtgaaggtccggcgcttcacccgttattgggtcacggtcgaggcccgcgcctgaaacctatcgcctctgtagccgctgccgcaggctgcgataaggcccgaagggccttcgaggacctcaagagcacgtccccttcggggccgatcgcagcctgcggcagcggctacaaatcagcgccgattcaaggttttttccgacgcgcagattttttttcattttgtgtgagccgttttccagcactcgcgtgacagagaaggaaagcccccttgactgcaaccttctcaggatcgatgtccatgccccagcgccccactcgccttacgccccttgcccgtaccctgcgccagttgctgctgggcgccagcctgagcttttccgccctgccgctggccctcgccgccgacggcccgacgcgcgattaccacatcgcggcggcgtcgctggaaaacgccctgaaccagttcggccgtgaagccggggtgctgatttccttcggctcccaggtcaccagcggcgtgcaaagccagggcctggaaggccgctacaccaccgaagaaggtctgaatgccttgctcaagggcaccagcctgcaagcccgcgccgaaggcaacaatgccttcagcctgcaaccggtgagcgccgagggcgcaccggcggccctggagctgggcgcctccagcgtggtcggcgattggctgggcgacgcggcgcagaccaacgtcttcgaacacccgggtgcacgggacgtgatccgccgcgaagaattcgaacgccagggcgcgacccaggcccgcgacgtgctcaaccgcatccccggggtcaacgccccggaaaacaacggcaccggcagccacgacatggcgctgaacttcggcattcgcgggctcaacccgcgcgtggcctcgcgctccacggtcctgatggacggcattccggtgcccttcgcgccctatggccagccgcagctgtccttcgccccggtcagcatgggcaacatggacgcggtggatgtggtgcgtggcggtggcgcggtgcgttacgggccgcagaacgtcggcggcatcgtcaacttcgtgacccgcgccattcccgatgcgcccacggtcaagggcggcttccagaccgagaccagcccgtcctccagccacgacggtttcaagaccaccggcaacctgctggccggcggcaccgccgacaacggcctgggtggcgccctgctgtactccggcacccggggcggtgactggcgcgaacacagcgacacgcaaatcgacgacctgatcctcaagggccactaccaactcgacgacgccaacagcttcaacgccatggcccagtactacgagggcgaggccgacatgcccggcggcctgaacgtcgccgactacaaggccgacccgtatcagtcgacccgcccgtacgacaagttctggggccaccgcacgctgatcaacttcggttatcgctaccaggaagatcgtcgcgaattcaccgtcaacagcttcttcaccaagaccctgcgcagcggctacctggaccagggcagcttcctgtcgctgtcgccgcgcgaatactgggtgcgcggcgtcgaaacccgcttcgcccaaggcttcgacctggggccgaccagccatgagctgggcatcggctaccgctacatcaacgaggccggccacgagctgcgctaccgcacgccgatcagtgccaaccagcaactgcccagcaccagcagccgcaacgaccgcgatacccgcggcggcaccgaggccaatgcattcttcgtcgacgaccgcatcgacatcggcaagtggaccctcaccccgggcatccgctacgagatgatcgagtcccagcagaccaacaacctgaccaacgtcaaatacaagggcgactacaacaccgcgctgccggcgctgaacgtgatgtaccacctgaccgacagctggaacctctacgccaacaccgagggttcgttcggcagcgtgcagtacagccagatgcccaaccgcgtgagcagcggcgaagtgaaaccggagaaggcccgcacctgggaactgggcacccgctatgacgacggcagcctgcgagcggagatcggcgcgttcctgatcaacttcgacaaccagtacgacagcaaccagaccaacgactcggtgatcgcccgtggcgaaacccgtcaccagggcatcgagaccagcgtcaattacgcgctggacggcctgagcccggcgctggccggtttcggtctgtacgccacctacgcctatgtcgacgccaccattcgggaagacgggccgaacaagggcaaccgcgtgccgttctcgtccaagcacaaaggcaccctcggcatcggctacaccgaaggcccgtggaagctgaacttcgacagcagctaccagagcagccagttcgccgacaatgccaacacctccgccgaaagcgccgacggcagcaccgggcggattcccggctacatgctgttcagcagccgcgccgcctacgacttcggcccgcaactatcggacctgagcgtggcggtcggggtgaagaacatcttcaaccaccagtacttcacccgttcgttcgacgacaacaacaaaggcaagtacgtgggcgaaccgcggaccctgtacgtacagacctccgtggcgttctgatccaaggccaccgcctggctgtaggagcgaagcttgctcgcgatagcatccggcctgacacaccgcgccgccttcatcgccggcaagccggatcgccgtccgttcgctcctgcagaaacgtggcgcacaaaaaagggcctgcaattgcaggccctgtctgtggagaagtcagccgtcagctattgagcgcggcctgttcgttttccaggaattcctcttcaagcaaggcgtcggcctggccttcgcgggcgcttggcgctgccgcggcgcgcttgttgcgcaaccggccgaacaggtgttccagggaattctccagcttggtggccgctccttcgatggccagttccagggattcggctttgtgggtcacggaaatcggttgatggccttttggccgcgcctccagttggcagcgcaaatcgtggggaccgggcttgtcgccgttctcgtcccgcaggtgaacctcgactcgggtcaggtcctcctcgtagcgttcgagcgtgctctcaatggtagtacgtacccactcctccagtcggatgctgctttgaatatgattatcgctattgacctggatttgcatagttcttcccttatttcagctagctcgcgagaggaaccgcgtgcccctgagggcgtactttttgcggcctcttggttacagagttgggcagagcgcggaacaattcaaccccttaaaaaagataaatatctattcgcaaataaagccggacaaggagcaaaagcgctgttaatgtcgggagttgggtcgcctctgtccctggcctttttcactcataactgcccctctccgagagggtgctggctgcgaaaaatccccgcctcctccaccagccagtcgtgcaccgcgcgcacgcccggatggctcagcgcacccggcgcatacagcagcacataacgcttgtgattgggcaccgcgaggccgaacggcacaatcaaggtgccgcgctccagctcgtcgttgagcagggtacgccgggcaatcgccacccccatcccggcgatcgccgcctcgatggtcaggtggttgcgattgaaggtgtgcccacgccgcacatccgcgccctcgcagccgatggcattgagatagaactcccactccgcgtactcatagctgccgcgccaggcggtgatgtcgtgcagcaacgggaaatgcaccaggtccgccgggccgtgcagcggcggccgcccgcgcagcaggcccggggcacagaccggaaagatctgttcatccagcagggctgtggataacagccccggataactgccgtcgttgaggtcgatggccaggtcgaaatcgccttcatgcaaggccacgctgctgtcctcggccaccagccgcagctgaatgtccggaaaacgctgctgcagccggggcaaacgcggggtcagccatttgccgagaaacgacgggatcgagcgcaggcgcaaggtaccgctgatcatcccggcatccagccggcgcaattcggcgtcgatgctgccataggcctcgttcaccgtaatcgccagcctctgcccctcggcgctcagctccaccccacgggcgcggcggtgaaacaggcgaaagccgagccgctcttccagcaggcggatctgctggctgaccgcccccggggtgatgtgcagttcttccgcgcaacgggtgaacgacaagtgccgcgcggcacaggaaaacacatgcagccagacgtaggtctgggcatgaaactgacgactcatcgtttagtcctgctaaaggctgtcttaggaaaattcgttggtcagtcttgaccgagctaggcagtatcgccgacctaacgctcggcctacaaaaaatggcagcgatttctcttccattgcttgtaaggctttagcatggctatcagtgttttcgatctcttcaaagtcggtatcggtccatccagctcccacaccgtcggcccgatgcgcgccgccgcgaccttcgcccaggggctgtttgagcaagggttgcaggagcaggtgcagcgggtggaaatccgcctgtacggctccttgtccgccaccggcgtcggccacgccaccgaccgtgcctgcgtcatgggcctgatgggcgaatggcccgacagcatcgacccgcgcagcatcggcccgcgcatccagcaactgcgtgaaagcggcgagttgagcctcggcggtcgctcgaccatcgccttcgactggcaccgcgacctgttgctgctcgacgagagcctgccctaccaccccaatgccatgtcgctgtcggccttcggcgcggacggcctgctatggcggcagacctactactcggtgggcggtggttttatcgtcgaggaagccgaagtggccgaaggcgccccgacggccaacggcgtcgaactgccctacgacttcaacagcgcggtggaactcctggccctgtgccaacggcaccagctgcgagtctcggaactgatgatggccaacgaacgggcctggcgcagcgatgccgaaatccgcagcggcctgctgcacatctggtcggtgatgcgcgaatgcgtcgagcagggtctgcgccacgaaggcaccctgcccggcggcctggatgtgccgcgccgcgcggccaagctgcatcgcaacctgctggaaatcggcaagcccaacgtcatcagctcgaccctgtcggccatggaatgggtcaacctgttcgccctggcggtgaacgaggaaaacgccgccggcgggcgcatggtcaccgcaccgaccaacggcgcggcggggatcatcccggcggtgctgcattactacatgaagttcaaccccgaagcgtcggacgacgacgtggtcgacttcttcctcggtgccgccgcggtgggcatcctctgcaagaaaaacgcctcgatctccggcgccgaagtcggctgccagggcgaggtgggttccgcctgcgccatggccgccgcgggcctggccgaggtgcttggagccaccccggagcaactggaaaacgccgccgaaatcggcctggaacataacctcggcctgacctgcgacccggtcggcggcctggtgcaggtgccttgcatcgagcgcaacgcgatcgccgcggtgaaggcgatcaacgccacccagatggccctgcgcggcgacggtaaacacttcatttccctggaccgggtgatccgcaccatgcgcgataccggcgccgacatgcacgacaaatacaaagaaacttcacggggcggcctggccgtaagttgggtggagtgctgaggagcgctcccccaggccgtatgaaaactactgcgctcggcaatactgcgttaaaaacaggctcggaatgctcatgtaggcccctacagtcgaacgcgaccccggccgttcctcgcctgtttttgccttgtcttgccttcgctcgctacgttttcaaacggcctgaccgcctgtactacgtgagcccgagcaaaaataataacgaggcgataccgatgaccgatgtacgaacacccgctgccgaaaaccctgccgtagaaactgcccgcgacaccacgaccgccagccagggctggagcaagcacgacaccacctggatgctcggcctgtacggcaccgccatcggcgccggcaccctgttcctgccgatcaacgccggggtcggtggcttctggccgctgatcgtgctggcgctgctggccttcccgatgaccttcttcgcccaccgcgggctgacccgcttcgtgttgtccgggcgctccggcgacatcaccgaagtggtggaagagcacttcggcatcggcgccggcaagctgatcaccctgctctacttcttcgccatcttcccgatcctgctggtgtacagcgtggcgctgaccaacaccctgggcagcttcatggagcaccagctgcacatgaccccgccgccacgggcgatcctgtcgctggtgctgatcctcggcctgatggccatcgtgcgctgcggccagggcgtgatcgtgcgggccatgagcgtgctggtctatccctttgtcgccgcgctgttgctgctggccctcagcctgatcccgaactggaacggcgccttcttcgcctcggccaatgacggcatgtccatgccgctgttcctcaagaccctgtggctggcgatcccggtgatggtgttctcgttcaaccattcgccgatcatctcggcctttgccgtcgaccagaagcgccactacggcgcccaggccgaaggcaagagcagcggcatcctcgccgtggcccacggcatgatggtgctgacggtgatgttcttctgcttcagctgcgtgctggccctgtcgccggccgacctggccgcggccaaggcgcagaacatctcgatcctgtcgtacctggccaaccacttccagacgccggtgatcgcctatgcggcgccgctgatcgcgctggtggccatcaccaaatccttcctcggccactacatcggcgccagcgaaggtttccaggggctgatcgtgaaaagcctgcgcagccgcggccggagcctgtcgtcgcgctggctggagcgttgcaccgcgctgttcatggtcctcacctgctgggccgtggccaccttcaacccgagcatcctcggcatgatcgaaaccctgggcggaccggtgatcgcctgcctgctgttcctgatgccgatgtacgcgatccggcgggtgccatcgctgcgccagtattcgggccagctgtcgaatctgttcgtggtgctgatcggtctgatcgcactgtcagcgatcatttattcgttcatgccctgaaacgggtagccaaagaaaaacggaccttttggtccgttttttttcgcccccgggtttattggtcggcgcttttcccggcatgccctttgctttgcaagacctgaggaatacggacgttaataaacctcagcgaacggcctgccagtggtctggagatgcgaactaatcccgatcccggccggtcaatgactgcacgatacaatcaggcggtgacgcacatggataacccctttcaactgattaccgatgccttcgccccggaataccgggtcaacctgagcatccagggcctggacggcagcatcatgctgaccctgtccaaggccggccgggtcgtagccaagcgcatgatcagcgccgagcagcgcaacgatccgcagcggctcaagcgcctggtgcaaagcattcagttcggtatcgccatcgagcagggccacagtgccatggccatcctcgaagccatgaccaacagcgacagcttcaagctgccgctgccggccgccaagggccggccgcccctgagcgtggcgatttaaagctcgcccttctcgacttccgggtgctcactggaacccgcgccgactttgcgttgcgggtgttcgattttcaccgaggggaactgcgacgaggcgtagcgcaccaccaggatcgagaacgccagcaacaggataccgccacacaggtagatgatccccaggtccggcgggttgtggtgcgacacgttggagatcagcaggcgggtcagcgcggtgatcgccacgtagatcaggaagcgcaccggcatgtggttggtcttgaagtagatgccgaccatggcgcccagttcgaggtagatgaacagcaggagaatgtcatcgatcttgatatgaccttcttcgagcatcccgagaaactccatcaccgccgcccaggccgtcaccgcgccgatggcgaacagcgccaggtagtgaaaggtctcgacgaacaggttgcccagggactcggccagctgatggacgttctgccgcagtttctcggcccaattgattttcacgatggtttttccttaggtcgactcgaccggatgatgcgggttggacgtgacggttgttctgcatgcagaaaaaaggccagcgtcgggggtgagatggtggctgatgcagacaaggcacgttcaggccggcggcaatctgtagcagcgagcttgctggcgatagcgtctgttcagacaaggtgctgaatggccgctgcgcggatagcgggcaagctcgctcctacaggggaaggctgacaaacccggaaacccgactagattaaaaagccactattcaaagcagaaggattcgcttattcttctagcctgtatataaatacagtagtagcaaatacccattatcgtgaaggcatgtgaggtggtgaatggccgtcgaagtggtataccgcagcagccgagatctggagcgcttgttcatggataaagccgaagctgaccgtcatgacaaaatgctcgaactggctgaattgctggcgcaagtgttgcaaaaagccgtgccgtccctgagcgagcagcaggtggaagaagccgggatctacatggcgaagaaccgcgatgtgttcgccaaggccttcaagagccagccggacgccctgtccgaactgctcagcgcgccggttgcggcggccgagccagaggctccgctggcagcgcccgaagccgcggaacccgcagcaccggccaagcccgccaaggcgagcaaagccgccaagtaagcaggctcgaattgaacaggccctgggtttgcgcccagggcctttttcatgcctgtggaaaactaagggtccgtacgaaaagtcggcgagcgaaggtcaggcaaggcaaaaataggcgaggaacggccggggtcgcgttcgactgtagggacctacatgagcattccgatcggactcgcgcacgagcctgtttctgcgtaacgccgcaggcgtctagcgcgcagcatggcccgcgtagcgccgaaggcgcccagcgcgcagccacttttcgtacagaccctagggttgctccagcgcctctaccagcgccttgaaaaaacgcgccgcctcaccgccggtcaccacccgatgatcgaaggtcagggacagcggcagcagcggatgcaccaccaccgcgccgttcagggccaccggttcgtcgcggatcaccccggcagcgaggatcgccacttgcggcggcaccaccaccgggttggcgtaacggccgaacagggtgccgaagttggacagggtcagggtcgcgcccatcatctcctggggcggaatcgagcgtgcctgcacgtcggcgcgcaggcgcgtcaccccggccttgaggtccgccgcgtcgcgctggccgacattgcgcagcaccggcacgaacaggccgtcgggggtgtccacggcaatgcccaggtcgaggtgctggtgctgcttgatcgacaagctcttgccatcgaacgcgctgttgagcaccggttccaccgcgcaggccgccgccagcgccttggccaggcggatcaacggatcgcgggcctggccccagcggtgcaggtcggcatcgccgtaaatcgtcaccggcaccacctcggcatgggagcgggccatgttcagcgccatgctccggcgtaccccgcgcagccggtcgccgccgaaccgctcgcgcgcctgctgcgcggcgttttccacatcgccgcggctgatcagcccgtccttggccgaaccgctcaaggcactcacgtccacgcccagctgccgggccagttggcgcaccgccggcgtggcgcggaccgccatatgctcgcgggtcgagggcgcggcgccgacaaaaaaccggtcttcctggctggccccgccaccttcgaggcgcccgaccacggtgccggcatccgcctcgccttcgtagccgagcaagggttcgccgacatgcaggatgtcgcccggcgcgccataggttttcgccaccaccccgtcatagggcgcgggaatgtccaccagggccttggcggtttccaccgacaccagcaactgatcggccttgaccgcatcgccggccctgacgtgccattcgacaatctccgcttcctgcaggccttcgcccagatcgggcaatttgaaatatttcatcgcagcctcctcaggcgaagttcagggtgctgtcgcaggcgtgaagaatgtcttcgacgccggggatgtacagcgactccaggcgatacagcggcggtggaatgtccggcgcggtgacccgcaggatcggcgcctgcaactccagcaacacccgctcgtagaggctggcggcgatttccgcgccgacgccgcaggtgcgtggcgcctcgtgcacgatcacgcagcgcccggtcttgcgcaccgaggcttccagggtgtcgaggtccagcggcttgatgcaggcgacgtcgatcacctccgccgacacgccctgctcggccagcgcgctggcggcctgcaaggtctcgacgatgctcgcgccccagctgaccagggtgatgtcgctgccttcgcgcagggtgaagcaactgtccagcggcaggcgcttgccgtcgtccaccagcggttgcgggttcatgcggtagaggcgggtcggctcgaggaacagcaccgggtcgggatcgtcgatggccgccagcagcaggccataggcccgcgccggcgaggacggcaccagcacccgcagacccggaatgtgggcgaacaaggcttcggtgctttcactgtgatgttccggtgcgcgaatgcccgcgcccatgggcgtgcgcaacaccatcgggcaggtgatgcgtccgcgggtgcggttgcgcatgcgactggcatgggacaccaggtgctccatggtcgcgtagataaagcccatgaactggatttccactaccggcttgaggccttgggcggccatgcccacgaccagtccgccaagcatggtttccgccagcggcgagtcgatcacccgcttgaagccaaaactgtcgcgcagccccagggtggcgcggaacaccccaccgttcacgccgacgtcctcacccaggacaatcacgttctcgtcctcggccatggcccggtgcagcgccaggttcaccgcttccagcaggctgaatgtgccgttactcatggtccgcacctcccgcgcgacgagccagccgttcgaggaacacctcgcgctgctcggccagggccgccggccactgtgcgtagacgtagtccagtaccgactcgggggcctgggtgcccgccgcctcgaagttatccacagcacgctgcaccagcgcctggcattccaccatcagcgcctgctcgcggtttccgtcccagacgccctgcccgaccatgaagcgttgcaggcgcttgaccggttcttccagccaggcctgcttgacctcatccgcggcccgatagcgcgtggcatcgtcggcggtggtgtggtcgcccaggcgatagctcagacattccagcagcaccggtcccttaccatgccgggcacgctccagggccgcctgcacccggtcgtacaccgcgagcatgtcgttgccatcgacctgctcgccatggaagccggcgccgatggccttctgcgccagggtcggcgcgccgcactggatgcgccgtggcaccgagatcgcccactggttgttgttgaccacgaacaccaccggcaactgccaggtgcccgccacgttgagggcttcgaggaagtcgcccttgctggtggcgccatcgccacaggtggtcaccaccacccggtgctcgccacggatcttgaacgcgctggccacgccgcaagcatgcagtgactgagtagcgatcggcacacagatggggaaatcctcggccaccgccgggtcggcgaaatcgctgccgcgctcgtcgccgccccagtacagcaggatctcctccatgcgcaccccgcgcatcagttgcacggcggtgtcgcggtaatagggcaccagcacgtcttcgggccgcatcaggctgccgatggccacgccaatggcttcctggccgagggtcggcgcataggtgccgatgcgtccggtacgttgcagggccacggctttctggtcgaacaggcgggtcaggaccatctgccggtagagccgggtcagcagattgaagtcgtcggcccaggccggcaggtcgccgagcaactggccgtccggggacaaatagcgggtatagggaagtgcaaccttgtgcggcatcacatggctcctggcacgccgggtcagcgtgcagttgttgcgccccgtgcttgtggcgcggggcctacagggcgaaatgccgggtaaggccttcgcacctagcggtacagcacgcgctccgccaagtcgtcggccacccgcgccggggagcgcttttcagcctgggcgtgagcgaagacttcggtgagccgctggctgatcttcgacaggtgggcggtgatggtcgccaggtcttcaccgcgatgcttgagcgaaacgtagatcagcccgccggcgttgatcacgtagtccggcgcgtagaggatgccgcggttttccagctggtcggcgacctgcaggttggtcagctggttgttggccgagccggcgaccgccgagcagcgcagttgcgccacgctgtggctgttgagcacgccgcccagcccgcagggcgcgaggatgtcgcacggggtgctgagcaaggcttcgttggcgatcggatgggcgcccagttgctccatggccagttgcaccttgccggaatcgatatcgctgaccagcagttcggcacccgcggcatgcagctgttcggcgagggcgaagccgacattgcccaggccttggatcgccacccgcaagccttcgaggttgtcgctgcccaggcgggccatggcggtggcgcggatgccggcgaacacccccatggcggcatgcggcgccggatcgccggaggcggtggtgctggtgacgtgctgggtggtttgggcgatgcagtccatgtcggcgaccgaggtgccgctgtcgatggcggtgatgtagcggccatcgagttgctcgacgcagcgcccgaaggcttcgaacaaggcggcgcggctttcgacgtgtggcggacggatgattaccgccttgccgccgccgtggggcaagccggccagggcggccttgtagctcatgccctgggccaggcgcacggcatcgaccacggcactttcgtcgtcggggtaggcaaggtaacgacagcctcccaaggcaggccccaggcggctgctatgaatggcaatcaccgccttcaacccggtggccgggtcgacgctcaggtgcagcgattcaaggcgagtgctttgcatgagagcgaacatcgtcgggctcccgaatcacttcttgtagtcgccagtataggcttgtgcatgaaaattgctggagcgcgcgggaataagcccggtgcctttccgggctttaggaaataacctgctacggcatgtgtgcggcactggacgaacgcccgcgacggggctaaaacgaggcattcgccggagatttcgatgaacccgcgtcaagcttttttcgcctgcctgcaacagtctccgcccgcccttttcgaggcggcgctgtggatcgccgccgagcacgacaaagaggtggcgcccgagcagctgctgcaggacttcaaggagctgcaacaacgggtcagcacaggcttgccgctgctgccagtcagcgaactgggccagccgctgctgcggcgcatgaacgacctggggttccagcaggacgagttcttgccgctgcgcccgcaggcggcgctgctggacaaggtgctgcacacccggcgcgggcaaccgctggcgctggggctgatcgccctggagctggcgcggcgcctggaaatccccatggtcggggtcaacttccccgggcactttctattgcgcgtgcccggtgccgatcacctgctcgacccttgcggcgggcgccgcctgtaccccaacgactgccgtgagctgctggagcgccagtacgggccaaacatcaagctggccgccgagcacctggccacggccagcccgcagcagatgctccagcgcctgtcgcgcaacctgcgccagttgcacctgagccacgacgaccacctcaacgcattgatcgatgccgagcgggtcctggaactgggcaatggcagcgcctccgactacctggcccgcgccagcctctaccagcacctggactgccccaacgccgaacgcttcgacctggagcacgccctgctgctcagcgaagacccgatccagcgcctgcgcctgaccgaacgcctggggcatctgccgcccaatactatcgtgcactgatggggcgctctgcctcccatgccacaatgcccggcgacaactctccgtttgcttcaaggatgaacagcatgaacagcgccgaacgctttcttcaggattttcaccaacgtcgccccggcaccacgccgccggctttttccgggctgagcctgccagggcgcggttcatcctacgagatgctggcagccacgctcgccgccgctcagcctcgcgcacgggtgctggacctgggctgcggcgacggtttcctcctggatctgctggccaggaagtatcccgatgcccggttgactggcgtggacatgagcgcaaccgaactgcaggcggcccgcacccgcctcgcgaaccgcagcgtgctgctcaatgagcgggcccagtgcctgtcgatggccaccggcagcgtcgatgccgtggtctcgcacctggccctgatgctgatgagcgatatcgaacaggtgctgggggaaatccatcgggtcctggccaagggcgggcaactctcggccatcgtcggccgggcctttctgttgggcgagccgggccagcactacctgcaggcctttcgcgccgccgcccgacgcgaccagctccgtcccctgcccctggtggatccccgtactcagtcacagcgtggatggcgggagctgttgggccacagcttcacctcgctgcacttcgaggaactggaccttgagtggacgcctaccttcgaggagctctgggattcgttggcagaaacctacgacctggatcgcctgacacccgccaatcgcgccttgatgaagagcgaactgcgcacggccacacaacccttgctgcgggcggacggcacgctgctgaccggctgggggctgctgctgatccaggccagggcggcatgacagccccgcccgggctctggcaggatgctcggctcacaccagggaatgggcacagcatgctgatcagaaaagctcatggcgacgacgcgcaacgcgtcttcgtcattcgcaaccaagccatcaaccaccagtgcagcggccattaccccgccgccgacctgcaggtctggaccgccggcagcctgggggactacttcgtcgaagtcctggagaagaccgggcacgtagccgtcatcgacggccagatcgccgccagcggcatgctcgatccggagtcggggcaggtcgatgcggtgtttgtcgatccggcgtacatgggccgcgggatcggccggcagatgatggactacctcgaacagctggcactgcaggccggcctgccgcacctgatcctggactcgaccctgaacgccgcagacttctatcgccactgtggcttcgtcggcgagcaggttgcccagtaccattcgccccggggcctgaccctggcctgcgtgccgatgatcaagcatctggcacgctgagcccgcgcgccttcagggtttgagcggcgcctgcagttccggggctggccccgcgcctggcgaaggcgcctcggacggcgagcgcacctggatgatcagcagcgccgcaatcactgccggaatcgcgcagaagaaaaagatctgctgcaccgggatgtgcatcgccagcagcaggctgccgaacagcgggccgaggatcgagccgaagcgtccgacgccgagggcccagccggtgccggtggcgcggacatgggccgggtagaagttgctggcgaaggcgttgagggtcagttggccgccgatgatgcagaagccggcggcgaagacgaaggccaccaggtaacgcgggttgtcgtggttcaggcccaacagcagggtgcacagcgccgccccggccagcaccgccgagagcagccgtaccttgcgttgcaggcggtcggcgaaccaggccatgcagatcgcccccagggtgccggcgaacaggaacatcgaggtcaccaggttcgcttcgttcaaccccaggccactttccagcagcagcgacggcaaccaactgatcatgaaatacagcaggatcaggctgacgaaaaaggtcgaccagatcagcagcgtcgggcgcgcataaccgtggcggaacagctcgatcaccgtgagcttgctgccttgcccggcttggctctgcgcggccgaagcggccggtggctgccagtccggcaacatgcgcgcggtgaccctgcgcaggcgcgcataaggcggctgatcgcgcagcaggcgcggcaacgattcgggcaggaaccaggccaggaagggaaacagcagcaacggcgtgacaccgccggcgaggaacaccgcctgccagccgaagcggtcgataaagcccgcggcgacaaaaccgccggccgcgccgccgaaagagaaaccgcaggcggccagggtcaccatcagggtacgcaggcgcggcggcgaatattccgacatcagcgccatggcactgggcatcgccccgcccatgccgatgccacagataaaacgcgcggccatcaggctgttcagcgaatcggcgaacaccatcatcaccgtgaggctggcgtagatcagcacgcaggccagcaggatccgccgcacgccaaaccggtccgccagcggcgtcaccgccagcgagcccagggtcaggcccagcaggttggcactgaacaccggaccgaacgcggccttttccaggccccagtcccgggccagggccggcaccacataacccagcacctgggcgtcgtagccgtcagtgaccagcaacagggccaggagcagaagaagcaaccactgataacgcgacacgggacgggcgtcgagggccgcccggaagctggcaatctgattgtgcatcgcaaggtacctgctgttttttatggttatgggagccggcagaccgtcattgctcttgggcggcaaggatcggtcttgtgtacatcttcgggcgcgggagcacgctgctcccgcgagcctgtctcctgtagccgctgccgcaccacgctggtcgcaggacctccagcgccctcaggagcagcgcccgctgcgcggtcgtgcgcagcctcgcgttgctcggcagcggctacaggagtaaacccacgcaacacagtcgatgtagccgctgccgcaggctgcgatcgcctcaaagaggcgtggatcttcagaccgctgaaggccttcggccttatcgcagcctgcggcagcggctacacaggtcaggcaggtgtatcgggctggttggccgggtgggccttctggaacgccgggtgtccggcggccagggcggcgacccggcgaatccgcgggtaggcgtccagcggcaccttgaagcgctcggccgcgtacagctggggaatcaggaaggtgtcggccagccccggctgctcgccgaagcaataaccctgctcgccgatcaactgctcgactgccgccaggccgttactgatccagtggccgatccactccagtacccgggcctcgtcgtagccccactggcgcagcaggttctgcgtgctggagttgtgcagcggatgaatatcgcagccgatcagcaacgccaccgcccgctcgtgggcgcgggccgccagctcctgggagagcagcggcacctgtggataacgctcctccaggtactcgatgatggccagcgactggatcagcagctcgccgtcatcggtgcgcaaggccggcacgcggccttgggggttgatccgcaggtattgcggctggcggttggcaccgcccccggccgccagcaggttgaccggcagcgcctggtaatccaggcccttgagcgccagggcgatgcgcacccggtaggacgcggtcgagcggtagtaggtatagagctccatgacgcgcacctcttcttaacgggcaggcaggattttgccgcggcattcgccgaaaccgatggaggcgaaaccctcgcggcggcagcggccgcgcaggaggatttcatcaccgtcctcaagaaatttacgcacttcgccggacgccagttcgatcggtttcttaccgccttcggtgatttccagcaggctgccgaactggctgctttgcgggcccgacagggtgcccgaaccgaacaggtcgccggcctgcaactggcagccgttgacgctgtggtgggcaaccatctgcgccacggtccagtacatgtactgggtgttactcagggtcaggcggtgggccggcaggccttgctcgcgcatcgcttcggtgagcagcagcacttccagctcgatgtcgaaaccaccggcggcctggtcacgcttgtccagcaggtacggcagcggctgcgggtcgccttcgggacgtggcgtctgggcgcggcggaacggctccagggcctcggccgtcaccacccagggcgagatgctggtgatgaagcttttcgacaggaacgggcccagcggctggtattcccaggcctggatatcccgcgccgaccagtcgttgagcaggcagaagccggcgatgtgttcggcggcgtcgccaatggcgatcggctcgcccagctcattgccctggccgatccagatgcccagctccagttcgtagtccagccgcgcgcaagggccgaaggtcggctcgctctggccggcgggcagggtctggcccttgggccggcgtacgtcggcgccggaggcgcggatggtggaggcgcggccgtggtaaccgatcggcacgtacttgtagttcggcagcagcgggttgtccggacggaacagcttgccgacgttctgggcgtgctcgatgccgacatagaagtcggtgtagtcggtaattttcgccggcaggtgcatctggcaatcggcggccaggggcagcaacttcgcgcccagcgcctcgattttgccgcgcaggctgctgccttcgccgagcaattccagcaggcgttcgcgcagggcgacgcgggccgggcggcccagttcgaaaaaggcattcaactggccgccacgggtggcctccaccgccgccttggccgcgccctcgaacagcccggcgtcgagcgccgcttccaggtcgaagatgtgctcgccgatggccacgccactgcgcggcgccgaaccctggaggctgaacacccccagcggcaggttctgcaacgggaagtcggcatgatcgttggcggaggccacccagctgcgggtgatggtgggctgattcatgggttatctccgattcgggttgaaggtggcgggcagcgaggcccagcaagcgtcatagtcgttctgcaattgcgggcactgcagggcgaactggctcggacgcagcacctggctggtctcgaacatgaaggccatggtgttgtcgatcttgaccggttgcagctcggcgttgatggccttggtgcagctttcgccatccgggccgtgggcgctcatgcagctgtgcagcgaggcgccgccgggcacgaagccttcggccttggcgtcgtaggcgccctggatcaggcccatgtattcgttcatcaggttgcggtggaaccacggcggccggaaggtgttctcggccaccatccagcgcggcgggaagatcacgaagtcgaggttggccaggccgtgcacgctggtgggcgaggtcagcacggtgaaaatcgacgggtccggatggtcgaagctgacggtgccgagggtgttgaaacggcgcaggtcatatttgtacggcacgttgttgccgtgccaggccaccacgttcagcggcgaatgatccagctcgcagccccacagctcgccgaggaatttctgcaccagggtggtcggctgcttgaggtcttcgtaatgggcgaccggggtcaggaagtcccgcgggttggccaggccgttgctgccgatcggccccaggtcgggcaggcgcaggggcgcgccgtggttttcggcgatatagccacgggcctgcgggtccagcagttcgacgcggaatttcaggccgcggggcaataccgcgatctccagcggctcgacctccagtacccccagctcggtggcgatacgcaggcggccctgttcgggcacgagcagcaactcgccgtcggcgttgaagaacacgcgctccatggagcggttggcgcggtaggtgtagatgctgatcccggccggtttctgcgctgccgaattggcgaccatgttcaccaggccgtcgatgaaatcggtgggctcgctcggaatatccagcgggttccagcgcaaccggttgggcgtgatctcgcccagcggcccgcccgccagctggcgatccagcttggcgaaggccgggtggttggccgatggctggatgcggtacatccaggtgcgccgcgcttcgctgcgggccatggtaaaggccgtgccggagaagagttcggtgtagaggccgtacggggctttttgcggggagttctggccgacgggcaaggcgcctggcagggcctcgctggaaaactggttgccgaagcccgactggtacgccagcccggacgccgtggaatcgaggttcatggagcctcctggaagtggagttggcagcggccagcgactccatgggaagagctctcggcacgcctgcgttatttttatcgtaatccaattacgaataacgtaatttgattggtattgaccgtcaagctataaagacgcccattcgtcccgggatcacaccgcctccatggaaaagccgcgcagtaccagcgacagcaacggtaaacagaaagtccgctcggccgaggtcggcaccgacatcctcaaggccctggccgagctgtcgccagccacttcgctgtcgcgcctggccgaacacgtgcagatgccggcgagcaaggtccaccgttacctgcaggcgctgatcgccagtggtttcgccgagcagaacaccgccaccaaccactatggcctgggccgcgaggccttgcgggtgggcatggcggcgctgggcagcatggacgtattgaaggtcgccgccctgcccctggccgagctgcgcgatgaattgaacgagacctgcttcctcgcggtatggggcaaccagggcgcgaccgtggtgcatatcgaaccggccgtgcgcgcggtgacggtggtgacccaactgggttcggtgctgccgctgctcagctcgtccaccgggctggtgttcggcgcctacttgccgaatcgcgaaaccgtcgatttgcgcgagcaggaactcaagacccacgcgccccatgcgctggcggacgagcaggcctatgccgccctgtgcgagcagatccgccagcgcggcctgcaccatgtgcacggcctgctgatgcccggcgtggatgccttgtcggcgccggtgttcgacgccaccggcaaggtcgccgccgtgctgacggtagtcggcccgacctcgctgttccacgccgacgaaaacggcccggcggcgcaacgcctgctggccgcgtcccaggcggtgagctggcgcatgggttaccagccctagacgcggatacgccaaatcgtcaggtttgcggccgctgcgcgcccgatcgcaggctgcgccagcggctacaaaaccctgtagccgctgccaaaggctgcgatcggcggcgtagccatcgtcaaagcgggccgcgcggtttggcgggaggccgcgttgtcaggttggcggccctgatagctgtccgaccactacatcaatcccaacgccttggccttggccaccgcctgcgtgcgacgctctaccccgagcttgctgtgaatgcgccgtgcgtgggtcttcaccgtgtgcagggaaatgaacagttgctcggcgatctgctggttggagctgcccagggcaatcagttgcagcacctccagctcccgctggctcagcggactctcccctgccgtcggcagcggcacttcttcgggctcagccacttgctggacgtcaaacatccgcggctgacgcaaacgcaattcatgcagtgcctggtgcaagttgcaccgcgcaccgagctccagcccctcctgcaaggcacgggcggacaacgctcgatcccccagcaaaaaagctacctcggccagggccagctgcaactcggtctgcaggcacaacatgccccgttgccgggcctgttcgagcaggccctgcaagcttgccactggggcctcggcgcgctgcaggtacacctcggccagcaccagcaggtattcgatacgcggaatcagttcgagagtggccggtggcgcctggcgcgcctgcggcccgcggtagtgacgcagcaccctgctcaaggcctcccgggccagttccggccggccctgctgcaaccagaacacgctgctgacctgcaacagcacggcgcggtacaccgtgtccgggatctgccgttgctgcatcagccgctcggcatcgcgcagacgcacaaacgcgtgggcatagtcgccctggttggcggccaggaacgcctggccgagaaacccgtacaacgcgcgtttgtcatggctgagcaggcagcgttcgagcccgtcctggaaatgcccggcggcctgttccgcctggccctggcgcaaggccaggcgcccttggcgcaaggcgatacgaccgagcagcgggccgacccgataagcctggcgactcaacaattgctgcacatcgtccagcaggctctgcgccctgtggggcgccccgcgctgctccagcagttgggcatgatccagttccagcagcgcttcgaacagcaatgaatcctgggccctggccaggcacagcgcctcgcggttgagcatttgcgccacctccagttcgcccctgagcaaggcctgctgggtcaggcccgaaaggcacagcaggcgggtcggccaggcatgggccggcagttcgctcagcgcctcgagaaaatgcatccgcgccggttccatcaacccttgcagatgcagcagccacccttgctgcgcctgccagcgcgccaccagttgtcgctgcccggaggccgtcggctgcggcgcgaaacgcgccatctgcgccacgcaggattgcgcctggtcgaaacgcccggcgaacagcaaggccgctgtcaatagccccaccaactgcgggctgccgagcagcagttcgtcgccctgctgctcatgcagacgcaacagcaacaccacgttctgctgctcgaacagctgctcgaaactgaagtgctgcaacaggctgaccgccacttcgtattcctgcgccagcaacgcctgctcgaacgccgcctgccagtcctcctgcgcggcgaaccactggcaggcgcgacgatgccaggagcgtcccgccggccagggctcgtcgcgcatcagccgggccaggggggcgaacacttgcagccactccggcgcagggtcccagggttcgatgaaacagcccagctcctgcaacgcccgcaaatactgggcgccctccccggcgccgaacaggtgctcgcacaacgcggcattgaaacgcggcaggtgcgccagcacatgccagacctcggacagttccgccggcaacacgctgaacagttcgtgctccagatactccagcagggtattgggccgcccctgccggcacggcgcggccgccaggtcgctgccttcgagcagggcgatgcgtacgccggcgcaccagccggcactgcgctggaaaatccggctggcggtatggatcgacaaaggctgcggcaattgttgcagcagtcgctcgatgtccgcctgggtgaaggccagctcggggcccgtgcattcgtagagctggtcgtcgagcagcagccgcggccagttgcattgcggccggcgacggccgcccagccaccaggtcagcgccgggttgctgatcgccagcaggcggtcgagcagcaggtccaactgcggcgcggcgacccggcagtagtcgtcgaggaacagccaggtcggggtcggcacatgcgccagatgctccagcaccgcagcctcgtccgccgcggccaggcccagcgcccgcgccagctcgccgcacagttgcagcggtgtctgcgccgccccggcctggggcaaccagcacacccggcatgcgggcggcgcctgcaacaggcactcggcgagcagggccgtcttgccgctgccggccggcgcacagagcagcttcacccgcgccggcgatgccaggagcggggtactcagacggctgcgggacaggtggtgggaggacaaacggggcaggaatccaggacagggggtcatggcggtcattgcggcgtgccttttttatagttttagcctgcgtgccctcaccctagccttgtcgccggtgcttgttgagaagtattcagcgcgctgatccgcgcccataaaaaaggcgaccgatcggtcgccttttgccatcgtttgtatcccgggccttaccgcacgccggttgcgcgcagggcggccggggtgtagtcggcggccttggcggcgaaaccgaactcgaaactgtgcttctcttcgttcttcatccccagggcgaggtagcgcccggcgatgatgtcgtacagcgcttcgagggtgtaggccggtacctgggcgttgtaatagaactgcgcatgcccttcagccacccgccacagctggccgcgaccgtcgtagtggtccaccagcgccacctgccagctgtcctcgtcgatgtacatgtgccgcttggcatagatatgccgctcgctcggcttgaccgtgccgaccacctcccagacccggtgcagctcgtagcgggccaggtcctggttgatatgcccggccttgatgatgtcgtcgtacttgaggctcggcgaatccagcttgtagctgttgtaggggatgtacatctccttcttgcccaccagtttccagtcgtagcggtccggcgcgccggagaacatgtcgaagttgtccgaggtgcgcaggccgtcggcggcggtgcccggcccgtcgtaggccacttgcggggcgcggcgcacccggcgctggccggcgttgtagatccacgccaggcgcggctccttcacctggtcgagggtttcgtgcaccagcagcacgttgccggccaggcgcgccggagcggtcaccgcctgcttgaagaaggtcagcacgttggcgcctttttccgggtccaggtcggggatctgttgcggcaccgccacctcttcctcgaagcggatcggcgtgtagctgccgttggtctgcggcgtggcctgggtgatgatgcgccgcaggttgccgccgcgataacgggtggtgtggttccacagcacttccacgccgttcttcgggatcgggaaggcgtagtagcggttgccggtgaagttggccaggccgttgccttcgttgatcgcggtgacgttcagcgcgctgcgcttggccgattcgtagatgtccgccggcaggccgaccgtgcgatgggtcgggtagaccgggatcttgtaggtttgcgggtagcgcttgaacatcgccatctggccgtcggacagcttgtccttgtactggtcgacagtggccgcggtgatggtgaacagcggcttctcgctggcgaacgggtcggcgaggaagcccttggcgtccaccgccccggcgttcttgccgatgccgccggtccaggccgggatcgagccgtcggcattgccggccttctcggcgccgagcggggtcaggctggtgccgagcttgtccgcttcctgcggggtgaccgccgccatcacgttgaccgccagcagggtcaaggccagggcaccgcattgcaaaatcgtcttgcgcataaagttgtccttcttgaggccgggtcagaagttcacgccaaagctcaacgcgaggaagtcgcggtctttgagggtgttgtagtcgccgccgaaaaagtcggtgtagctgaggctggcggtgtaggtgttgcggtagtcggcatcgaccccgaggctcaccgccttggcgccttcgttgaacaggccgttgggcccgtagccgttgacgtcgtgggaccaggacaggttgggcttgaggttgatcccggcgatcaggttgttgtagtcgaggatcgcccgggcgcgataaccccaggacgtggccgtgacgaaaccgtcggtatcgccgccgaaaccgtactggccgtagaccgagtcgcggccgtagcgcagctggcttttcgactccaggccaccgacatgcacgatggccgcctcgcccaccagggtcaggcggtcggcgcccagcacctggtcgaagaactgggtcagggtgctctggacctgggtgatttccttgcgccggtaaccggtgttgtcggcccccgccgaggtccgcaccggcgacgccagaccaccggcgatggggttgaccagggccagggtcaggtcgttggtgttgacctgcaccggggcgttgggccggtagctgatctcgccggtccaggcggtgccggtgggcagcgtggtggagaagctggcgccatacaggcggatgtcttccgggtactcgaggtagtactggccgcgcccgagcatcacgctctgggccagggccgaaccagtgcccggggcgatgcggttggcggtgctgacgatccccggaatgctcgccagggtgctgcccggggccgtgatggtgccgaccgtcggggtgcgcgcatggtagttcatgaagtacaggccgtactcggtgtcgtcgcccagccagcgcaaggcggtgccccactgcccggagtcgcgggcatcgcggtcgccggcgcggccgatcaccacgccttcgggggccacggtgaagccctggccgaacgccgcggcaatcggttgcagcgggcggatcgccgggctgccgacggtgtagccagtggtgcagccgtccgccaccacgtcgttgccgaagaaggtgccgcagttgtcgaccacggtttggtcccactccagctgatagaaaccttccacagtcaattggtcggtcaggccctgggaagcgaacagcatgttcaccgggatcaggccttccttgatctcggcacccgggcggcgaaacgccgagacgtcgatcgggttgatgctgttgatcgagttgccgatgaaggtgctttcgccccagctgaccacctgcttgccggcgcgcacggtgcccggcaggtcggcaatggaatagttgtgatagatgaaggcgtcgaggatctgcccgccggacgacttggcgccctccttgcggttgtggtcgctgatgggcttgaactcgcggtcttcgtccttgagttcgaagtcgtaccagtacttgccgcggacgaagacgccggtgtcgccgtacttcagttcaaggtcatggatgcccttgaagatcttcgaaaaggtctcgcccttcttgaaattcagacgcccgtcatcgccggtggaagactgcccgcgaccgccgttggacacacccaccaggtccttgtcggcatcgcgcatgccccagctggcgccgatggacagcgaagaatcgaactgcccctcgatctccccgatgttgaatgaaacggcctgcgcctgggcgcagccccccaaggccaccgcgacggccagcgcccgcggtgtgaagatggcgcgcattgttgtttttgtcatgcgtcttccccggtgagtgacagaaggcctcaccctactgccggcgcacaggagcgataagcgcaccaaggaggtattcgcgctgtcgctcgaaaggatgaatgccccctccagccgggcctttgcgcgatgcatcgacgggctggatggacgggtatcaggtggatggattgcgcccttgcagggcagatccccacggcgtgcactactattgcccaggctgtaacagtccttgtccacaatcgctatttttcattgagcagccagcccttattctggcctcgctctcacggcaaacagccacgcagagtcgcccagaggtgtgatcacgccaccttgggggcaggaggattcagaaggtttgaagcaacgatattcagatcttcaccgggtgttcactgacgttgatttgttgctccttgatctaacgtcttccttcggccgctgccttgcagcggccttttttatgcccggtagaaagccaggtcgatgctcaaggtgtctgctcgccgcgataatggaaacgctgcaacaggcgatggactgacggcgccaggatcaggccgaaggcagtgatgaaggcataaggcaaacagccgcgcaggccgcggctgttcgggttggcgagcgctgcttcagatcgcgtatttctgcaggttctgcatcatctctttcaaggcttcgatgttgtccttggggtgcgccgcgccctcgaagtcgcagatctgctgccagtgcgccgcgacatcttccggggagaagccttcacgcggatcgaagcccaggcccaggctgcgctcccagcgcaccttgcccatccagccgccaccgacctcgaacaggccggaggtctcttggcagttctcgctgcccaggtacaccaccagcgggctgaccagctccggcttgagttgctcgaacacctggggcgggatcagcccttcggtcatccgcgtgccgccggttggcgcgatggcgttgaccaggatgttgttcttgcggccttcgatggccagggtgcgggtcaggccgtagaggccgagcttggccatgccgtagttggactggccgaaattgccgtagatgccggaggtggacgcggtgaagatcacccggccataaccctgatcgcgcatgtgcggccaggcggcgcgggtcaccttgtaggcgccctcgacgtggacgcggtacaccaggtcccaatcggcgtcttccatcttgtggaaggtcttgtcgcgcaggatgccggcgttgttcaccagcacatccacccggccgaaggcatccagggcgttctgtacgatcttgtcgccgtcggtgaccgaatcgtggttggcttcggcgatgccgccggcttcgcgaatctgcgccaccacccggtcggccgccgaggcattggcgccctcgccctgggtcgaaccgcccaggtcgttgaccaggaccttcgccccgtgccgggcgaacagcaatgcatgagcctgccccagaccgccgccggcaccggtgacgatcacgactttattctcgaagcgtacagactcactcataccgaactcccacaggccagatggacaacagacggacaatggcttcgagtgtcaggcacgcggctggcggtcacaataaacacggctggagctgaatggtgcgcaataaggctgggggatgatcgaggggtaacgacggcgtggggcgcatcggcgcctggcgtgcacaggccaaggtcgcagcatcgcgatagctgcggacagcgggtgtctcaggagcaggccagtttgcgcggtggaaactccaggctgtcgcgaaaggccagatagtgcttgagcacctggcctggagcctcggtctgcgggtagtgaccgatcccggccagcagcacggtatccggtgcagggatcagctggcagtagcgctcgaccatgtgcgccccggaaatcgggtccaccgcgccgtcgatcacccgtagcggcacctcgccgcgctgcattgcactcacccagcggtcgcgctgcacccggcgctcgggaatgtagccgatcaatttatgcaggatccgcgggccgttattggcctccaccagactccagaagtcatccagcacgctttcgctgggccgggtttgcgggccgaaaatctggctgaaactcttggccaggccctcacggctgaagacgcggccgagcatccagcccagcgggctgagcagcagcttctgcgtcagcaccgggcgatgggtttctgggaacaggccgccgttgagaaacacacagctggccatgttgcaacgctcttcgtagtgtcgggcgagcatttcctgggcgacgctgtcgccatagtcgtgggccagcagatgcacggggccatcgacccccaggtgctcgagcaaggcctgctgcaggtccgcctgttccagcaggctgtactcatggttccgcggcttggccgaatcgccaaaccccagcatgtcgcaggcgatcacccgatagcgctgcgccaggggttgccacaggtagtgccagtcccaggcagcggtggggaaaccatggatcagcagcagtggttcgccctgccccgcggtccagtagcgaatggcatggccgcgaaacacgaagctatgtccgcgcttgcgccacacgcacagaggaatctcggccataggcatcagagtttataacccgcgtcttgtttatcgagtttgcgcagcagtgccggccatgccagcgcgccgcccatgccttgagcgcttttggtgaccccggcgatcatcgccctggccccggccagaatctgcggctcgatggcgatcagttgcgccgcaccgttctgcgccagcacctggatctcgcaggcgcgctggaaggtgaacatcatcaggaaggtgtcggcgatggtgccgccacaggtcagcagaccgtggttgtgcagcatcaggaaatggctgtcgccgaggtcggcctgcagccgggccttctcctcgtggttcagggccacgccttcataggcgtgataggccaggctcgacaacacgaacagcgactgctggctgatgggcaacaccccctgctgctgcgcagacaccgcgaccccggccgcggtgtgggtgtgcagcacacaggccacatcgtgccgcacttcgtgcacggcgctgtggatggtgtagccggcggggttgatctcgtaggggctgtccatcagcttgttgccggcctggtcgaccttcaccaggctggaggcggtgatctcatggaacatcaggccgaacgggttgatcaggaaatcttcggtgccagggaccttggcggagatgtgggtgaagatcagatcgtcccagccatacatcgccaccaggcgatagcaggcggccagatcgacgcgggtctgccattcggcggcgctgacctggtctttcacactcgatgtcgattgaacagaggataggctcacggcaaggacctcagtgacggcagttttttattatgttttttcagacgtggagtcagtctagtcagccacccgggttcgggtagttgcctttgcagccagcttactggccgagcgagtcagtggtcattttagttgcaatcggcacaggtcaaacgtcaaagcaacgacgccaataaaggggcggcgaacaagttcagcagaccggtgagaaccatcaccagccccgccaccgagccctcttcaccgccgacttcatgggcgcggctgaccccggcgccgtgggcgccgaccccgaacaacgcaccgcgagccagggcgctgcgcagcggcagccacttgagcaggacaccaccgagcatggcgccgaacaccccggtgaacatcacgaacaccgccgtcagttcgggtacgccgcccaggtcactgggccagcggcatggcgaatggcgtggtgatcgaacgcggcaccagcgacatcgtcaccgagctgtccagggccagcacccgcgccagtccgaaggagctggcgatggacgccgtgctgccagccagcatgcccaagagcaatgccggccaatggcgcatcaacaattgccgctgctgccagatcggcaccgcgaaggccacggtgaccggccccagcaccagcatcagccagtgggtattggcggagtattcggcataggcggtgtgcagcggcacggcgatcgccagcagcagggccggcaccaggatcagcggcgacagcaggtagcgcccggtgcgtcggtagatccagcgactgaacagataggccgcgagtgtcagcagcagccagaacaccggcatgggttcaagcgtcatggcgcattctccagcggcacacccattccaccgtaaacgcggtgaccagcatcaccatcagcgtactgacgccaatcaccagcaggatccgccagccgtcctggcgcagcaggccgccgtagtccagcaggctcatcagcgctggaatgaagaacagcagcatctcggccatcagcaggcccgcgcccatctgcaacgccgccggcttgacccagcccagggcgaacgccaacagcagcaaggccaggccgatcaccccgccaggaatcggccacgccagccacccggccagctgacagccgaacagataaatagccagcaacaccgccaattcggataacaggcgacccaggtgtttcaaggtggaagcgttcatggaattcggtcctcgcaggcctgcattttaggcaagcgcctgccatcaccgaagcgaattgttagacttgaagccattccaaaatggaattcagagcacggactcaaacccatggacttcaaacagctgcgcagctttgtcgaagtgattcaccagggcggcttcacccaggccgccaagaccctgcacatcagccagtcggcggtgagcaagcagatcgcccagctggagcagagcctgggcacgccattgctggatcgccagggctcgcacattcatctcaccgccgccggcagcgtggtgctgcaacgcgccgaaggcatgctgcgcctgcgcaatgagttgctcagcgagcttgacgacctgagcctgttggcccgcggggaattgcgcctgggcctgcccctgctgggcagcgacgcactgttcgccggcctgttcgccgagtaccgccggcgctacccgaacatcagcgtgcagctgctggaaggcggcagcctgaatatcgaacaggcggtgctcaacggcgaactggagatcggcggcagcctgacgcccaaggatccgaccttcgcctaccagccgttctgcgacgaaccgctggacgccttgctaccggccgatcatccgttggcgatcaaggcccaggtgcgcctggaggaactggcggacacgccgttcctgctttatcagcgcagtttcgtgctcaacgaccggctgttgcaggcctgtcagcaggtggggttcaccccgaaggaaggtgggcgcagcggccaggcggactttctcgccgctctggtggccgccgggcaaggcgtggtgctgttgcccagcgtggtggcgcgcggcctggtccggcccggcgtggtgcgcctgacgctgcaagcgcccgacgacctgcgctgggacatcgccttcatctggcgccagggcgcctatctgtccaaggccgcgcaagcctggctggcgctgctgcgcgagcgtccggtcagccgcgcagagcgctgatcaactcggccagccaaggctcggcgtcggtttccggggtcacgctttcgctggcgtccaggcgcagcattgccagcacctcacgcacgcccagttcggcgaacagctcgcgcatctgctcgccaccgccacagaaggtgtcgccatagctcgaatcgcccaggccgatcaccgcgccgggcaaaccgcgccaggccgccggcagttgatcgcgaatggccgaatacagcggcagcaggttgtccggcaactcgcccatgccggtggtcgaggtcacggccaggaaggcctcggggccgaacgcctggacatccgcgagggtcgcgcgcgggttgtgccaggcctcgaaacctgcggcattgaggagcttggcggcgtgccgggcgacttcttcagccgtgccgtacaccgagccggaaaggatggcgactttcatcaatctgatcctgaagctgagtaaaaggctgggatattagcagctgcgcgataaaatccagccttgtagcgcgatttacccatcatggccagtggacagcttcgcgccatgtcttagaattgccgccacctgccgatcgactgcggaaagcctccgatgatcaacgcccatctgctgcaattggtgatcaacgcctccaatgacgggattgtcgtggccgaacaggaaggcgaagacaacatcatcatctacgtcaacccggcgttcgaacgcctcaccggctacggcgccgacgaggtgctgtatcaggattgccgctttcttcagtcgggcgaccgtgaccaaccgggaatcccgctgattcgccaggccctggatagcggccagccctgccgccaggtgctgcgcaactaccgcaaggacggcagtcacttctggaacgagctgtcgatcaccccggtcttcaacgaaagcgaccaactgacctattttgtcggtgtgcagaaagatgtgacggtccaggtcaaggcccggcaacggctggcgcaggtggaaaaggagttggccgaaacccgcgcgaagctcgccgattaccaggcgacgaatggcgctaacaagatgtcgaattagttgtcagtacgcttaatcaccaatgattttgtcactttttccttcgagcaacatcatgcgccgtgacgctctcctcacccaggatgaactggacttcattcagaccatgcagcacaacccgcaactcaacgtgcgggatgcgaactcgagcctgctggtcaatgggggctcacagatccgcgacctgctcacccgcctggcggccaacgagcaagtgaccatccaggcgcactttgaaaaccagcagatgacctttcccctgcaactggtggaagacgagttccacgcgctgcatctgcgcctgggcgtgccgagcatcttcgaggatgggccgagggtccgcccctggcgcctgacgctggacgagccggtggccttggaaaacgccaaggggcagcccactgcgctgtgggtgcatgaggtgtcgttcaacagcgtgttgctggaaatccgcaaccgggccaaagcaccaaagcagttcgcccagtggttcagcccgtcgggttacgagcgcatcgccctgcgcggccgcctcgaacgccagaccgacgcgggcttctatgcctatcggttgaaccagagcgacacggatgaaaccgagcgcctgcgccagttcatcctgcaacagcaccgcctggcacaccccaacctgcacatctgaaatcgcagcttttggctgcctgggtatcagctcaggtatcgagcgtaccgctgagaaactgccgcaggcgctgcatcatcaaacgcccgtcactccccaggcagcccaccggcgaagcgctcaggctgtcctgggccagctcggcgacatcccccgccagcatcagcggacactccagggtcagcgccaggcggttcaagcgtcgaggcaactccggcgccggcgcgtgattggaaaacagcaccagcgcctggggtttgatcttctcgcagaccagggtcagctcgtcgaacggctgccccagcgccagcacccggacttccaactcggcactgcccagcatcagcgccgccaccagcaattccagttcccggcattgcccggcaagcgccgccagcagcaccgggcgcagcggttggccgcgctgcaacagcaggcgctgggagacccgcgaacgcaggaagtgatcgaagaacagccactcgctggtgtggccataaggttcctggtgctgcgccagctgccgccagaacggcatgaggatgtcctggaacaccaccgacaatgaatagctggcgaagatctggccgtacagccgctccaggtgcggctcgtcgaagccgccgaccgcccgcttgagttgcccctgccactgcaggtaatcgcccgatgcgctgtcgcccggcatggcctgcggcgcctcgcgggcggcccgggtcttggcgaggatcttgccgaccttgctgaccgcgacacctcgatcgatccagccgaggatctcgcggaccgtctcgacatcgtgcatcgaatacaaacggtgcccactctcggtgcgcgtcggctggatcaatccataacgacgctcccaggcccgcagggtcaccgggttgatccccgtgagccgtgaaacttcccggattggaaacagatcgtcctgcgagggttggtcgaggggctgtgtcgggcgggaaagttcagtaataacgggcatctgggcagaaaacaccgatggataaagtgacggccattctactccccatcggtgacagttcttcaacacagggcaaagcgaccgctgcctctggtgtatttgtcacaatcagaaataatccttgcttgctttcaagacgcagcccaacaccccggtgctgcgtccggcgtacggccttacccaggcagcgcattggttttacggagatacataatgtctacctcacccgtcaccctgatggtcgcccggcgtgtcgccgatggccgttaccaagacctgatcgcctggctgcgcgaaggcgaacaattggccaccgacttccccggttatctcggctccggcgtgctcgctccgccgcccgacaatgacgaattccagatcatcttccgcttcgccgacgagcagaccctgcacgtctgggagcactccgcctcgcgcaccgcctggctggcccgcggcagcgacctgttcgcccatccccatgaacaccgggtcagcggcatcgacggctggttcggcgcggccggccagcgccctccgcgctggaagcaggcggtggccatctggctggcgttcttcccggtgtcgctgatcttcaacttcatcctcagcccgttgctcggcgaactcagcctggcgccgcgggtgctcgtcagcaccctggccctgacgccgctgatggtctactggttcattccgctgtccacccgcctgctgtccgggtggctgaacagcacgccagcccgtccgctgccgacagcaccctccccgcagagccaccggtaggaaccggctcgccggcgatgaacgataacgcggtctgccagacagaccgcggcgccatcatcgcgggcaagtcggattgccgcccgcccgctcctgcagcggcttgggcgaaccccgccccgcgctggtatagttttgctctacctgcgacgcgagccgttcatgactacttcccctgccccgatcctgatcaccggcgccggccagcgtgtcggcctgcattgcgcattgcgcctgctggaagacggtcaccgggtgatcatcagctatcgcaccgagcgcccgggcgtgcaggccttgcgcgagcgtggcgcgattgccctgttcgctgacttctccagcgaagccgggatccaggccttcatcagccaattgcacgagcacaccgacagcctgcgggcgatcgtgcacaacgcctcgcaatggctggaggaaacgcccggccaggaaagcgcggccttcgccgacatgttcagcgtgcacatgctcgcgccctacctgatcaacctgcattgcgccgacctgctgcggcgctccagccccgccgacatcgtgcacatcggcgacgacgtcacgcgccgcggcagcagcaagcacatcgcctattgcgccaccaaggccggcctcgacagcctgaccctgtccttcgcggcgaaatatgccccgacgatcaaggtcaacggcatcgccccggctctgttaatgttcaatcccgacgacgacgcggcgtaccgcgccaaggccctggccaagtccgccctgggcatcgaacccggttgcgaggtggtctaccagagcctgcgttatctgttcgacaacccttatgtcaccggcacgaccctgaccgtcaacggcgggcggcacctcaagtaaggcttcccgcgaggacgttgcatgacgctttccctgccccagcactaccgcgagatcctcaagggtctcggcgaagaccccgagcgcgaaggcctgctcgacaccccgcaacgtgcggccaaggccatgcagtacctgtgtcatggctacagccagtcggtggacgaggtggtcaatggcgcgctgttcgcctccgacaacgatgaaatggtcatagtcgccgacatcgaactctattccctgtgcgaacatcacctgctgcccttcatcggcaaggcccatgtggcttatattcccaccggcaaggtgctgggcctgtcgaagatcgcccggatcgtcgacatgttcgcccgccgcctgcagatccaggaaaacctcacgcgggaaatcgccgacgcggtgcagcgggtaacccaggccgccggcgtcgcggtggtcgtcgaagcccagcacatgtgcatgatgatgcgcggagtcgagaagcagaactcgaccatgcacacttcggtgatgctcggcgcctttcgcgattcgagcaccacgcgccaggaattcctgcaattgatcggacggagcaagtagcaatgccacaacttcagccaggaatggctcgcatccgggtcaaggacctgtgcctgcggaccttcatcggaatcaacgaggacgagatcctcaacaagcaggatgtgctgatcaacctgaccatcctgtatgccgcgcaagaagccgtgcgcgacaacgacatcgaccatgcgctgaactaccgcaccatcaccaaggcgatcatcgcccacgtggagggcaaccgctttgccctgctcgagcgcctgacccaggaaatcctcgatctgatcatggccaacgaatcggtgctgtacgccgaggtcgaagtcgacaaaccccacgccctgcgttttgccgagtcggtgtcgatcaccctcgcggccagccgctgatatcatccgcgccacatttgatcgcacagagccgaacatgaccgagcaacaacgcctggaactcgaagccgccttccgccgcctggtcgcgcacctggacagccgcaaggacgtgcagaacatcgacctgatgaacctcgccggcttctgccgcaactgcctgtccaagtggtacaaggccgaggccgacgagcgccagatcgaggtcagcctcgatgacgcccgtgaagtggtgtatggcatgccctacgccgagtggaagaacctctaccagaaagaagccagcgccgagcagcaagcggcgttcgccaaaggaaaaccccatgactgacctgaacaccctgcgcgccagcctcaagagcggcgagcatgtcttcgccgacaccctggcctttatcgccacgggctacgactaccagccgcaggccttcaacaacggtggcgtggaaaacgccgccgggcagaacgaaggttcgtgcaagaccctgggcctggccctgctggaaggcttgagcgacgaagaagcgctgctggcgttcggcgaacattaccgctcggtactggccacccctgaaggcagcgaccacggcaatatccgtgcgctgatcgcccatggcctggcgggtgtgaagtttgcccagcagccactgacccgcaaggcctgggtctaaaccctgtagccgctgccgcaggctgcgatggtccgggccacgctggtcgcaggacctcctgcgccctcaaaagtggcgcccgcttcgtcggaatgccgcccaaatcgctcactgcctcgcgctgctcggcagcggctacaagtttcaatgatccataaaaaaaccggcctgggccggttttttcattgcaacggtctgagaatcaagcgttctgcaggccgtccaggtagcgctcggtgtccagggcggccatgcaaccggcgccagccgaggtaatggcctggcggtacacgtggtcggccacgtcgccggcggcgaagatgcccgcgatgctggtggcggtggcgttgccttcacggccgccctgcacgaccaggtagccgtccttcagctccagctggccttcgaacagcgaagtgttcggggtgtggccgatggcgatgaacacgccgtcaaccttgatttcgtcgaagctgccgtcgttgttcttcaggcgcgcgccagtgacacccatgttgtcgcccagcacttcgtccaggttggcgttcagcttgagctcgatcttgccttcggcaacccgggcattgagcttgtcgatcaggatcttctcggcgcggaaggtatcgcgacggtggatcagggtgaccttgctggcaatgttggccaggtacagggcttcttcgacagcggtgttgccgccaccgaccacggccactggcttgttgcgatagaagaaaccgtcgcaggtcgcgcaggccgacacgcccttgcccatgaacgcttcttccgaaggcaggcccaggtaacgagcgctggcgccagtggcgatgatcagggcgtcgcaggtgtaggtcgcgctgtcaccggtcagggtgtaaggcttggcggcgaagtccacggcattgatgtgatcgaagacgatttcggtctcgaaacgctcggcgtgttcacgcatgcgctccatcagcgccgggccggtcagaccgtggacgtcgcccggccagttgtcgacttcggtggtggtggtcagctgaccgccggcctgcatgccggtaatcagcagcggcttcaggttggcgcgtgcagcatagaccgcggcgctgtaaccggcagggccggaaccgagaataatcacacgcgaatgacgtacatcagacatgactcactcctatcgaccggcccggatcactggcgcggaacgccggattgccggctggaataaaaaaggacggcgaaagcacttggggaaggcttcaggttcgcccgtccgaaaaataatgggtgcagcgtatagagggggcgaagattaaggaaatacggtttaacaatccagctcataggaggtctctatccggtatcgatgtatttaccggcgcctttgttacagttgatgtcgacctaacgactgcgctttcgccggtggggcaaagccggtaaggtcggcgcgttttccccttgcacggagctccttatgcccgcccccgttctctccggcccgcaatacctgcgcgaaggcctcaagctggtgctcagccccggcttgcgtctgttcgtccttttgcccctggccatcaacctggtgctgttcgtcggattgatctatttcgccggccaccagttcagcctgtgggtcgacaccctgatgccgtccctgccggactggctgagctttctcagctacatcctctggccgctgttcgtggtgctggtgctgctgatggtgtttttcaccttcaccatgctggccaacgtgattgccgcgcccttcaacgggttcctcgcggagaaagtcgaagtggtggtccgcggcaccgatgatttcccgcccttcagctgggccgaactgctggccatgatcccgcgcaccctggcccgggaaatgcgcaagctgggttatttcctgccacgggccatcggcctgttcatcctgtccttcattccagtagtgaacctggtggccgcgccgctgtggctgctgttcggcgtgtggatgatggcgatccaatacatcgactacccggcggacaaccacaagctgggctggaacgagatgctcgcctggctgcgggaaaagcgctggcagagcatgagctttggcgggatcgtctatctggtgctgctgatcccggtggtcaacatcctgatgatgccggcggcggtggccggggcgacgctgttctgggtgcgtgagcgcggcgcggaaaacctggtggcccagcaaggctgagcgggtcacaaatccatcatcgcaacgtcacaatgacgacatggcctcggctgacactaaggccatgacgacagctctgcatatcactctgatcaccgaaaccttcccaccggaaatcaatggcgtggccaatacccttggccgcctgtgcgatggattgcgcgcccgtggacaccaggtggaactgatccgcccgcgccagggcagcgatcagagccggatcagcgacgacggcctgctgctgtgccgcggctggccactgccgggttatccggggctgcaatggggccagtcgtcgatgcacaagctgctgcggcgctggaaacgccatcgcccggatgtgctgtacatcgccaccgagggcccgctgggcctgtccgcgctgcgggcggcgcggcgcctggggatctccgtggtcagcggtttccacactaacttccagcagtactccagccagtacggcctgggtttgctgacgcgcctgctgactcactacctgcgctggttccacaaccgctccaagctgaccctggtgcccagcgccagccagcgcctggagctggagcggcgcaacttcgaacgcctggcgctgctgtcgcgcggggtcgacagccagctgttccacccggccaagcgcctcaacgaactgcgccaaggctggggcctgggcaacgacgatatcgcggtgattcacgttggccgcctggcgccggagaaaaacctgggcctgctcaaacgctgcttcgcccagctacagagcacttatccacagcagtcgatgaaattgatcgtggtgggtgatggtccgcaacgcgcggtcctgcagaaggagttgccggacgccgtgttctgcggctcgcaacgcggcgaagcgctggccagtcactacgcgtcgggagatctgttcctgttcccgagcctgaccgaaaccttcggcaacgtggtgctggaggccctggcctcggggctggccgtggtggcttacgaccaggccgcggcggcccagcatattcgccatggctacaacggtgtgctggcgatgcccggggacgaatgcgcgttctgcgatgccgccagctggctgctggaagatcccgagaccttgcgccgggtgcgcctcaatgcccgccagcacgccagccgccagggctgggcggcgatcatcgagcagtttgaaacccagctgcgcggcgcctgcatggaagaagtggtggtgcctgaggggcgattgttgccctgaaaacatcgcgagcaagctcgctcctacctagacagtgcccgttgtaggagcgagcttgctcgcgatagcgtttccagaggccgtgctcagaccagcgtcatcaacgcctcacggctgaacggcaggatgtcctgctcgcgaccgtcccgtaccttctgcgcccagtccgggtccaccagcaacgcgcgtcctaccgctaccaggtcgaattcgtcgttgttcagacgctccaggagcttttccaggctcgccggctgcgccaccttgtcggtgttgaccatgaactgcaggaactcgccgtcgaggccgacgctgcccacggtgatggtcggcttgccggtgagctgacgggtccagccggccaggttcagcgcggaaccctcgaactccggctcccagaaacgccgggtagagcagtggaagatgtccacgccggcgtccgccagcggcttgaggaactcgcccagggcctcgggggtttggaccaggcgggcgctgtagtcctgctgcttccattgcgaaaaacggaagatgatcgggaagccagggcccaccgcggcgcgcacggcctggatcagctcgatggcaaaccgcgaacgctgggccaggtcgccaccgtactcgtcggtacgctggttgctgccctcccagaagaactggtcgaccagatagccgtgggcgccgtggatctccacgccgtccatgccgatgtcctgggcatccttggcggcctgggcgaaggcggcgatcacttcgccgatgtcgtcctgggtcatgccgtggaccaccacctggccgtccttgagtttttccgacgggccgtaacccggcacgctggcgtccggctcggtgcccaggcggcgcacattgcccacatgccacagctgcggaacgatcttgccgccttcggcgtgcaccgcgtccaccaccttcttccagccggccagggccgcttcgccataaaaacgcggaacgttcggatagccgttggaggccttgtgcccgaccgtggtgccttcggtgatgatcaggccgaccccggccgcggcgcgacgacggtagtactcgatgactttcgagttcggcacgccacctggggaaaacgaacgggtcatcggcgccatcaccacccgggtcgacagctccagggcacccagctgaaagggtttgaacaaggcttgaacgggcatgcggtactccagggctgacggtcttaatcgcggaaaatggcaagtcgggcgggtacaccgacggccttatgatggcgataatattccgtgctcccggcaacgcccagcactattgatcggggtgattaaggtgccaaagcggaggaaagtgaaggtgcgcgaacgcgcggtaaaaccggccgggcagcggggcccggcgtgcagattcagctcaaggctttttcgatggcctggatgaccgtcgaatcgtcgggcgcggtgcgtggggagaaacgcgccaggacgcggccgtccttgcccagcaggaatttctcgaaattccaggtgatatcgcccggaaactccgccccttcgcccgccagcagacggtacaactgatggcgctccggaccgttgacgtccagcttgctgctcaacggaaaggtcaccccgtagttgaggctgcagaattcctgaatctcctgctcggagcccggctcctgcccagcaaactgattacacggcaggcccagcacgctgaacccctggcctttgtattgctggtagaggttctccagcgccgcgtattgtggtgtcagaccacacttggaggcgacgttgaccaccagcacgacgtgccccttgaaaggcgcgagcggtagctcctgaccatccagggctttcaatttaaggtcgtgaaaagcactcatgacgaactccaaattcccgtgttcttgcagaaaacagccactcgacagtaccgcctgttgcccggcgataaaagccgccgactaaaaaggcgccctcgggcgcctctccagtcagatttgagcttagcgcagaaatcagtggtgatggccaccttcgccatggacgtgaccatgggcgatttcttcctggctggcatcacggatgtcgacaaccttgaccttgaagttcaggcgctggccggccagcgggtggttgccgtcgacagtcacgtcgtcgccgtccaggtcgcggatggtgacgatctgcatctggccgtccggagcggaagcgtggaactgcatgcccacttccagttcgtcgacgccttcgaacatgctgcggctcagggtgctgaccagttcggcggcgtattcgccgtaggcatcttccggctcaacggcaacgctcagctcgtcgccgacgttcttgccttccagggccttttccaggcctggaataatgttccctgcgccatgcaggtagaccagcggtgcgccgccggcggagctgtcgatgacctcaccagcgtcgttggtgagggtatagtcgatggagacagccttgttggcggcgatcagcatggggcgagaccttttgcataagaatgaagaacgtccaagtttagcgaagcaatcgcccgaaagcgaacggaacccggacaaacggaacctgacgcctggctcgacgatcgtcggctttcatcaggatgaagacggccactgggtcgtcgagctgtcctgtggccacgcccagcacctgcgccaccagccgccctggcaatcccgggcctggatcctggatccgctcaagcgtgcggaaaaaataggctagccctttgcctgcggttggtgcgcacaaggctcggttagcgctaaccttggcgcctgaatttccggtagagcagtaaacataagcgactcaccgtggccatgcacccgtcgagaatccgcatgcaaactttttttatcgcgcccaccgattttggtgtgggtctgacctccatcagcctcgggctggtgcgtactctggaacgggccggcctcaaggtcggcttcttcaaacccattgcccagccccacccaggcgataccggccctgaacgctcgaccgagctggtggcccgcacccatggcctgaaaccgccgcagccgctgggcctggcccatgtcgaacgaatgctcggtgacggccagctggacgaactgctggaagaaatcatcaccctgtaccagcaggcggccgtcggcaaggacgtgctggtggtcgaaggcatggtgccgacccgcagcgccagctatgccgcgcgggtcaacctgcacctggcgaaaagcctggatgccgaggtgatcctggtgtccgccccggaaaacgaagtgctcaccgagctgtccgggcgcgtggagttgcaggcgcagttgttcggcggcccgcgcgacccaaaagtgctgggagtgatcctcaacaaggtgcagaccgacgaaagcatggaagccttttccgcccgcctgaaagagcactcgcccctgctgcgcagcggcgacttccgcctgctcggctgcatccccttccagccggaactgaacgcgccgcgcacccgcgacgtcgccgacctgatgggcgcccaggtgctcaacgccggtgattacgaaagccggcgcatgaccaagatcatcatctgcgcgcgcaccatgcgtaacaccgtggagctgctcaagcccggcgtattggtagtgacgcccggcgatcgcgacgacatcatcctcgccgtgagcctggcggcgatcaacggcgtgcccctggccggcctgctgctgaccagcgacaccctgcccgacccgcggatcatggagctgtgccgcggcgccttgaatgccggcctgccggtgctgtcggtgagcaccggttcctacgacaccgccaaccagttgaacggcctgaacaaagaaatccccatcgacgaccgcgagcgcgcggagatcatcaccgacttcgtcgccagccacctggacgccaagtggctgcaccagcgctgcggcacgccgcgggaaatgcgcctgtcgccggcggtgttccgctaccagttgatccagcgcgcccaggaagccaacaagcgcatcgtcctgcccgaaggcagcgagccgctgaccgtgcaggccgcggcgatctgccaggcgcgcggcatcgcccgttgcgtgctgctggccaagccggcggatgtcgaggcggtcgcccgggcccagggcatcgagctgccgcctggcctggaggtcattgatccggaccagatccgcgaacgctacgtcgagccgatggtggcgctgcgcaagagcaagagcctcaacgcgccgatggccgaacagcaactggaagacccggtggtgatcggcaccatgatgctggccctggacgaagtcgatggcctggtgtccggcctgatccactccaccgccaataccatccgcccggccctgcagttgatcaagaccgcgccgggctgcaccctggtgtcgtcggtatttttcatgctgttccccgagcaggtgctggtctacggcgactgtgtgatgaacccgcacccgagcgccagcgagttggccgagatcgccctgcaaagcgccgactccgcggccgcgttcggcatcaccccacgggtggcgatgatcagctattccagcggcgaatcggccagtggcgaagaagtggagaaagtccgcgaagccaccttgctggcccatgaagcccagagctcgctgctgatcgacggcccgttgcaatacgatgccgcggccaacgaggccgtggcccagcaactggcgcccaacagcctggtcgcgggcaaggccacggtcttcgtgttccccgacctgaacaccggcaacaccacccacaaggccgtgcagcgcagcgccgactgcgtcagcctcgggccgatgctgcaaggcctgcgcaagccggtgaacgacctgccgcgcggcgcccaggtcgacgacatcgtctacaccatcgccctgaccgcgattcaagccgccaaccgacccctggatgtgtaaattggattttctacctgcaccgctgcggggcgtgatcgcctcgctgttgttggcgctcaacaccatcgtctgctgcaccccgctgttcgtggtggcgatcttcaagttgctgctgcccttcccggcggcccagcgcttcaccgactggctgatgagccacatccatgaagcctggatcagcaacaacaaggcctggatgagcctgctcgggcacacccgctggcacctcagcgggctcgacagcctggactaccggcactcgtacctgatcaccagcaaccaccagagctgggtcgacatcatggtcctgcagtacgtgctcaaccggcgtatccgcccgctgaagttcttccttaagcaggagctgatctgggtgccggtgatcggcctggcctggtgggccctgggtttcccgttcatgaagcgctactccaaggcctacctggaaaaacacccggagaaaaagggcaaggacctggagaccacccgcaagacctgcgcgaaattccgtgacaacccggtgggcatcttcaacttcgtcgagggcacacgcttcacccaggccaagcacgcgcaacaggcctcgccgttccgctacctgctcaagcccaaggccggcggcatcgccttcgtgctggacgccatgggcgagcagctggaatccatcgtcaacgtcaccattcattatccggcgggccagccgggttactgggacctgctgtgcggcaaggtcaacgaggtggtggtgcatttcgaggagttgccgatcccgccgcagttcatcggcaagaactacgaccaggatggcgtgtaccgcctggagttccagggctggatcaaccagctgtggcagaacaaggatgcgctgcttgcgcagatgcatcgggagtatccgggcaaataacggaacatccgcgatagcttttcaaggcacaaaaaagcccgccgtcgatcactcgacggcgggcttttcattggacgccaaggcttagatcgcgccgcgcttgcgcagcagttccagcacttgcttgacgccttcttccagcgacacggactgggtgtcgatcaccagatcggcatccagcggcacgtcgtacgggaaggactcgcccgggacgtatccccacccgcagcgtacaggccctgcggatcacgctcggcgcagaccgccggcgaagcctggacgtagaccgtcagcagacgctccttgccgatcaggtccctggcctgttcacggccttccgcactcggcgcgacgaatgccgccagggtcagcaggccggcttcgttgaactgacgcgccacgtgcgcggcacgccgccagttttcggtacgcccggcgcgatcctggggcagccccttgttcaggtcgtgacgcaggttctggccgtcgaggacgaacaccgcacggcccatgtcgaacagcttgcgctcgaccgcgtaggccagggtgctcttgccggcgccggagaggccgctgaacaacacggtggccggttgctggccgaagcgctgggcgcgctcatcggtggctacatgggccagcttgccatggtgcgtggcgctgccatgcaccacaggctgggcgacgatcataccggcgccgacggtgccgttggtcaagcggtcgatgacgatgaaggcaccggtggtgcggttgctgtcgtaaccgtcgagggcgatcggcgcgtcgagggcgatcttgaccttgccgatctcgttcagctgcagagcgctggccgggccttcttcaagggtgttcacgtcgaccctgttgacgatgctggcgatggagcccggcacgtaactggtggcgcgcttgatgtcgtatttcttgcccggcagcatcggctcttcggccatccataccagcatggcttcgaagctgtcggtcaccggcggtacgttgtcggcatgcaccagcaggtcgccacgggagatgtcgatctcgtcttccattgtcagagtcacggcctggcccgggccggcatgctccagctcgccttcgaaggtgacgatggatttcacccggctgctcttgcccgacggcaacaccacgacttcgtcgcccttgtgcacgatgccgctggccagggtcccggcgaaaccacggaagttcaggttcggacggttcacgtactgcaccgggaagcgcagatcgctgaagttgcggtcgcccgccacttccacggtctcgaggatttccatcagcgactggccggtgtaccacggcgagcgctcggacttgttcaccacgttgtcgcccttgagggccgacatcggcacgaagtgcagactggtgggcttcatcttcaggccttcggcgaacttcaggtagtcggccttgatcgactcgaacacgccctggtcgaagtccttgaggtccatcttgttgatggccacgactatgtgcttgatgcccagcagggaggcgatgaagctgtggcgacgggtctgggtctgcacgccgtagcgggcatccaccaggatgatcgccaggtcacaggtggaagcaccggtggccatgttgcgggtgtactgctcatggccgggggtgtcggcgatgatgaatttgcgcttggcggtggagaagtagcggtaggcgacatcgatggtgatgccctgctcccgctcggcctgcaggccgtcgaccagcaacgccaggtcgatgtcgtcaccggtggtgccgacttttttcgagtcgcgggtaatggcttccagatggtcttcgtagatcatcttcgagtcgtgcagcaggcgcccgatcagggtgctcttgccgtcgtcgacgttaccgcaagtcaggaagcgcagcagttccttgcgttcgtgctgggccaggtaggcgaggatgtcctcgctgatcaattcggattgatgcgacatgttagaccctacttagaaatagccctgacgtttcttgtcttccatggaaccggcgccatcgtgatcgatgacccggccctggcgctcggaagttcgcgtcaggagcatttcctgaatgatgtccgtcaggctttcggcctcggactccaccgcgcccgtcaacgggtagcagccaagggtacggaaacgcaccttcttcttgacgatgcgggccttctcctcgtcggagaggtgctcgagaatgcgctcgtcgtcgatcatgatcagggtgccgttcttctcgatcacttcgcgctcggcggcgaagtacagcggcacgatcgggatgccttccagatagatgtattgccagatgtccagctcggtccagttcgacagcgggaagacgcggatcgactcgcccttgttgaccttgccgttgtagacgttccacagctcggggcgctggttcttcgggtcccagcgatgcttgctgtcgcggaacgaatacacgcgctccttggcgcgggatttctcttcgtcacgccgggcaccgccgaacgccgcatcgaaaccgtacttgtccagcgcctgcttgaggccctcggttttcatgatgtcggtgtgcttggcactgccgtgggtgaaagggttgatgccctgcgcaacgccttccgggttgacgtgggtgatcagttccaggcccagctcttcgaccatgcgatcgcggaacttgtacatctcctggaatttccactgggtgtcgacgtgcatcaccggaaacggcagcttgcccgggaagaacgccttgcgcgccaggtgcagcatcacggcggagtctttaccgatggagtacagcatcaccgggttgtcgaactcggcggccacctcgcggatgatgtggatgctttccgcctccagctgtttcagatgcgtcagtttgtcgaccatggctactcacgaaagctttcttatggacggcctgcgggccgtgttcgagcggggcatgctagcacagcgacctcttctaatcaggacgccagctagatcgaaacggtatatgaatatacccgcctgtttgttgtgtttacgcctctctgtagccgctgccgcaggctgcgatcgactgcgcagcaggcgtgctctcgaaggtcacgagaagcccctgcgggccttgtcgcagcctgcggcagcggctacaggacaaggctttatatagggttcgggcagtcgatgaacaagtgttcgagggcgaagcgtcgggccaggtagtcccccagcgcctgcacgccgtaacgctcggtggcgtgatggccggcggcgatgaaactgatgtcattttcccgggcgctgtggaaggtctgctccgaggcctcgccgctcagatacagatcgacgccggccagcaccgcctggtcgatgtagccctggccgccgccggtgcaccagccgacacgccggatcatcttgctgccttcgaccaccagtggctcgcgccccatcacctcctggaccttgcgcgcgaagtcccgcgcggtcatgggctcggcaagggagccgaccagcccgacgatcttcaggttgtccgggtccagcggaccttccacggtgatatccagctgccgcgccagctgcacgttgttgccgacatccgggtgcaggtccagcggcaggtgataagccagcaggctgatatcgtgcttgagcagggttttcagccggcgctgcttcatgccggtgatgcaggggttctcgcctttccagaaataaccgtgatgcaccagcaccagatcggcattggcctccaccgcggcatcgagcaacgcctggctggccgtgacgccgctgacgatgcgcatcacctgtggccggccttcgacctgcaggccattggggcagtaatcggcgattcgcgaactgcccaggtagcggtccgcttcctctaccagagtgctcagggcaacggccataaaagactcctaaatatcccgttcagaggcgcgcgcggcctcgtataatgcgcgacattatgggccgtcccgggcggcctgcaacctctcaggacttgctcaatgctcaaggctctgcgtttttttggctggccactgttggccggcgtgcttatcgcgttgctgataattcagcgctacccgcaatgggtcggcctgcccagcctggacgtcaacctgcagcaagccccacaaaccaaggcgcttcgacaaggcccggtgtcctatgccgatgccgtggcgatcgccgcgccggcggtggtcaacctgtacaccaccaaggtcatcaacaaaccggcgcacccgttgttcgaggacccgcagttccgccgcttcttcggcgacaacctgcccaagcagcagcgcatggaatcgagcctgggttccggggtgatcatgagccccgaaggttatctgctgaccaacaaccacgtgaccgccggcgccgaacagattgtggtggcgctcaaggacggtcgtgaaaccctggcccatgtgatcggcagcgatccggaaaccgacctggcggtcctcaagatcgatttgaagaacctgccttcgatcaccgtcggacgctccgacagcatccgcatcggcgacgtgaccctggccatcggcaacccgttcggggtcggccagaccgtgaccatgggcatcatcagcgccaccgggcgcaatcagctgggcctgaacaactacgaagacttcatccagaccgacgcggcgatcaacccgggcaactccggcggcgcgctggtggatgccaacggtaacctgaccgggatcaacacggcgatcttctccaagtccggcggttcccagggcattggcttcgccatcccgatcaagctggccatggaggtgatgaagtcgatcatcgagcacggccaggtgattcgtggctggctgggtatcgaggtgcagccgctgacccaggaactggccgaatcgttcggcttgtccgggcgcccgggcatcgtggtggcggggattttccgcgacggtccagcgcaaaaagccggcatgcagttgggtgacgtgattctcagcatcgatggcgaaccggccggcgatggccgtcgctcgatgaaccaggtggcgcggatcaaacccagcgacaaggtcagcatccaggtgatgcgcaacggcaaggagctcaagcttaccgctgaaatcggcctgcgcccgccaccggcgccggtcaaggaaaaagagtaaaggcatcgcgagccagctccctcctattggagcgagctggctcgcgatagggcttacagctcgcccaggccgtcgatcagggcctggttctgctccggcgtgccgatactgatccgcaggaactgggcaatccgctcctgcttgaagtgccgaacaatcacaccctgctcccgcagcttggccgccaggcccgccgcatcgtgttgcggatgacgggcaaagatgaagttggcggccgacggcagcacttcaaagcccttggcgcgcaactgcgccaccacctgctcgcgactgtcgatcaccagctggcaggtcttggcgaagtactcgcgatcgtcgaacgccgccgcagcaccgacgatcgccaggcgatccagcgggtaggagttgaagctgttcttgatccgctccagcgcttcgatcaggtccgggtgccccaccgccaggccgacccgcaggccagccagcgaacgggacttggacagggtctgggtcaccagcaggttcggatagcgatccaccaggctgatggcggtttcaccgccgaagtcgatgtacgcctcgtccaccaccacgaccgaatccgggctggccttgaggatctgctcgacggcctccagggccagcaggcaaccggtcggcgcgttcgggttggggaagatgatcccgccgttcggcctggcgtaatcggctgggcggatctggaactgctcatccagcggcaccgcctcgaagtcgatgccgtacaggccgcaatacaccggatagaagctgtagctgatatccgggaacagcagcggccggtcgtgctgcagcaagccatggaagatgtgcgccagcacttcgtcggaaccgttgccgaggaacacctggttgctctgtaccccgtaatagcgggccaccgcctgcttgagcaggtcgctgttggggtccgggtacaggcgcaggttgtcgttcagttcgccctgcatcgcggccagcgccttgggcgacgggccgtaagggttttcgttggtgttgagcttgaccagcttggtcagcttcggctgttcgcccggcacgtagggcaccaagtccttgacgaacggactccagaatttactcatgcttattgcccctgttcctggtcagcgatgatccggtattccgcactgcgggcgtgggcgctcagcgactcgccacgggccagcaccgaggcagtcttgcccagttcggaagcgccctgctccgagcagaaaatgatcgacgaacgtttctggaagtcgtacacccccagcggcgaggaaaaacgcgccgtgccggaagtcggcaacacgtggttcgggcccgcgcagtagtcgcccagggcctcggaagtgtgacgacccatgaagatcgcgccagcgtgacggatctgcggcaaccaggcctgcggatcggcgacggacaactcgaggtgctccggagcaatgcggttggccacgtcgatggcctgctgcatgtcgcgcacctggatcagcgcgccacggccgttgatcgaggtattgatgatttccgcgcgctccatggtcggcagcagcttggcaatgctggcggcgacctggtcgaggaacgcagcgtccgggctgaccaggatcgcctgagcatcttcgtcgtgctcggcctgggagaacaggtccatggcgatccagtccgggtcggtctggccgtcgcacaccaccaggatctccgaagggccggcgatcatgtcgatgcccacctgaccgaacacgtgacgtttggcggtggccacatagatgttgcccggaccgaccaccttgtccacctgcggcacgctctcggtaccgtaggccagggcggcaacggcctgggcgccaccgatggtgaacacccgatcgacgccggcgatgcaggccgcggccagcaccaattcattgacctcgccacgcggagtcggcaccaccatcaccacttcggtgacgcccgccactttggccgggatggcattcatcaacaccgaggagggataagacgccttgccacccggcacatacaggccggcgcggtccagcggcgtgaccttctggcccagcaccgtgccgtcggcctcgatgtagctccaggagtcctgcttctgtttttcgtggtagctgcgcacccgcgccgcggctttttccagggcttcgcgctgggccagggtgatccgggtcagggccagttccaggcgctcgcgcggcaggatcaggtcggccatggatgccacttgcaggccgtcgaaacgctgggtgaattccaccagcgccgcgtcgccgcgctcgcgcaccgccttgatgatatccagcacccgctgattgaccgagtcgtcagacacactttcccagctcagcagatgatccagatgatgcgcgaaatccgggtcagcagcgttgagtcggcgaattgcagtgggagcggtcatagcgagggcctcattgaatggctaatgctcaggcaccctaagctaccagtccattcgcgcgggcacctgagaaaattggctatgacacggatagacgggcgcggctcgcgccgcgcgagtgaatcaaccgcggtgtcgcgactccactgctttgcgcagggtgtcgatcagtgcctggatgcgggcgtgctgcattttcatggaggccttgttgaccaccagacgggaactgatcatggaaatcagctcctggggctccaggccgttggcccgcagggtattgccggtgtcgaccacgtcgatgatcttgtccgccaggccgatcagcggcgccagctccatcgagccgtacagcttgatgatgtcgacctggcggccctgctcggcgtagtagcgcttggcaacgttgacgaacttggtggcgacgcgcaggcggcccttgggctcgaccgcgccgatggcaccggcggtcatcagcttgcactgggcgatctgcaggtccagtggctcgtacaggccctggccgccgtattccatcagcacatctttgccggcaacgccgaggtcggcggcaccatgttcgacataggtcggcacgtcggtggcgcgcacgatcaacaagcgcacgtcggcctgggtcgtggggatgatcagcttgcggctcttgtccggattctcggtgggcacgatgccggcttcggccagaagcggcaaggtgtcatcaaggatgcggcccttggacagtgcgatggtcaacatgggaaacgtaagtccttatcaggatactcatgcccggtcgcaaatggcgccagacacgcatcgagcctgaacagaggctcgacttggaacgaaaccttggggcacgtccctgtgcccatcacgcaaactagcccggtacgcggcggatcttggcgccgagcatctgcagcttctcttcgatgcactcgtaaccacggtcgatgtggtagatgcgatcgatcagggtgtcgccttcggccatcagggccgagatcaccaggctggccgaagcccgcaggtcggtggccatcactggagcacccttgaggatttcggtgccggtgacgatggcggtgttgccttcgacctggatcttcgcgcccatgcggtgcagttcgtaaacgtgcatgaagcggttttcgaagatggtctcgatcaccgcgccagtgccttcggcaatggcgttgagggagatgaactgggcctgcatgtcggtcgggaacgccgggtacggcgcggtacgcacgttgaccgccttcggacgcttgccgtgcatgttcagctcgatccagtcctcgccggtggtgacttcggcgccggattccttgagcttttccaggacggcttcgaggatggtcggatcggtgtccttgaccttcacgcgaccgccagtcacggcggcggcgaccaggtaggtgccggtctcgatacggtccggcatgaccttgtaggtcgccgagtgcaggcgctcgacaccgtcgatggtgatggtgtcggtaccggcgccggaaaccttggcgcccatggcgttgaggaagttcgccaggtcgaccacttccggctcgcgggcggcgttctgcagcacgctgcggcccttggccagggccgctgccatcatgatgttctcggtaccggtcacactcacggtatcgaagaagaagtgcgcgccgcgcaggccgccttcaggcgccttggccttgatgtagccgccttcgacgtcgatcaccgcgcccatggcttccaggccgcggatgtgcaggtcgaccggacgcgaaccgatggcgcaaccgccaggcagcgcgacttcggcttcgccgaaacgggcaaccatcgggcccagcaccaggatcgaggcacgcatggtcttgaccagttcatacggcgcgaccagggtcttgatggtgcgtgggtcgatttcgacgctgagcttttcgtcaatcacaggctcaatgcccatgcgaccgaacagctcgatcatggtggtgatgtcgtgcaggtgcggcaggttggcgaccgtgaccgggccatcgcacagcagggttgcagccagaatcggcagggcagagttctttgccccggaaatgcggatttcgccatcaagacgaacgccgccggtaataatcaatttatccataagaatctcgacgcccttgggctcaggtgcgctcggcccaagccgcgctgctgaaaaatttcatagtgaccgcatggatgctgccatcggcgatccacgggttcaaatgggcatagatgctctgctgacgcttgaccggactcaaggccaccagttcgtcactgatcacattcagctgaaagttgcagccttcgccctcaacttctacctgaacggatgaaagagtctcggacagctttccttcaaggaagctcttcacttcgttggcctgcatgctcaacctcaatcggcgccctgtgcgcgcgggtcggacatcatacaaaaaagccccgcgcctgcgaaccccgcatagcaggactctgacggggggcttgcttgtcgatgggttactaaggctgcgccagcagctcggtcaaaccggaaacctcggcgatttcgcgcatgtcttcaggtaacgcacggatgctgacggccttgccggctgccgcggcgtcgcgcatgaaggccagcagcaacgacaagccgacgctgctagacttctccaccgccgaacagtcgagcaccagcgccgccgcggtgctggaggcgatcagggcctgcccctgcttgcgcaggcccgggccggaacgatagtccagcacaccgctgatcagcagttcgccggcttcacccagacggacggccgactcactcatttcacgaccttctctggagagttttcggtcgattccttggccttggccacttcgccagcccagttgttgatggtcttgtccaggtcattgccgttgcgctgcatggcatcggcgaactgatcgcggaacagcttgccgatattgatgccgttgatgatcacgttgcgcagcttccactcaccgctgatcttctccagcgtgtacgacacaggatagatcgcaccgttgctgcccttgaccgtcatgccgacgctggtacggtcacccgactcgtccctggcagggtcaacgacgatgccctggttgttgtactccagcaaggcgttgccatagaactggaacaggcccttcttgaagttctcttcaaaggtgtgcatctgttccggcgtggctttacgcgagtacttgaccgtcatgatgctcttggaaatgccttcggcatccacgaccggccccacgatgctgttcagcgccgcataaaagtcctgcgggtcctgcttgtacttttctttgttggcggccaggtcggccagcagacggttggtggtgtcctgtaccagatcatgcgcggaaggcgccgccacggcgtgagccatcaacggcaacgccgccagtaataccaacaggctacgtcgcaaggtagagatcatgaaaaaatcctcatttggcgtctttgctaacggtattgagcaggaatttaccgatcaggtcctcaagcaccagtgaagactgggtgtcgtggatggtcccgccatccttgagcaacgtgtcttcgccgccgacgctgataccaatgtatttctcgccgagcaacccagcggtcaggatagatgcagtggagtcggtcggcaggttatcgacgcgtttttccaactgcagcgtgacccgaccggtgaaactgtcgcggtccagatcgatagccgtgaccttgccgatggtcacaccggccatggtcactttagctctgaccgtcaaaccggcgatattgtcgaaatatgcataaagtttataagtatcggtgctcgaggtcggggacaagccactgacccgcaaggcaagcaacagcaaagccaggatgccagccagcaggaaaaggccgacaccgatttccagggtgcggttttgcatcagaaatctccaaacatcaaggcggtcagaataaagtccaggccgagtacagccaacgaggcgtacacaacggtcttggtagtggcacgactgatcccctctgaagtgggctcgcagtcatagccttggaatacggcgatccaggtcacgacaaaggcgaaaacgatgctcttgatgatgccattgagcacgtcatcgctgaacgtcacgctgttttgcatgttcgaccagtaggaaccttcatagactcccagccagtcgacggccacccacgaaccgccccagatgcccaccacgctgaaaatgatcgccagcaacggcagggaaatgaaaccggcccacagccgtggcgcgataatgtatttgagcgggtcgacaccgatcatctccaggctggagagctgctcggtggctttcatgttgccgatttccgcggtcagcgccgaaccggcccggccggcgaagagcaatgccgtgaccaccggccccaactcacgcaacaaggtcagggccaccatctgccccaccgcttgctccgaaccgtagctggacaggatattgaagccctgcagcgccagtaccatgccgatgaatatcccggagaccacgataatcaccagggacatcacgcccaccgaatgcagctgcttgaccaacaggccgaagccgccgccgatactgccgcggccgaacaacacatgaaacagcatcaggctcgaacgcccgagcaccgcgagaacgtcgatgcccgagtggccgaacagacgaattcgctccaataaagatactttgcgcatcagcgcttccccagaagatctgcgcggtagtccggcgctggaaagtgaaagggtaccggaccgtcggggtcgcctttcatgaactggcggatccgcgggttatcggaatccatcagctcgtcgggcgtgccctgccccagcacctggccatctcccaccacatagatgtagtcggcgatgctcgcggtttccgccaggtcatgggaaaccacgatgctggtgatacccagcgcgtcgttgagcagacggatcaggcgcaccagcacgcccatggcaatggggtcctggcctacgaatggctcgtcgtacatgaggatctgcgggtccagggcgatggcccgggccagggccacgcgacgcttcatgccaccggacagctcgtcgggcatcaggtcgatggcaccgcgcaacccgaccgcctgcaacttgagcaggacgatatcgcggatcatttcatccggcagctgggtatgaacgcgcagcggaaaggcaacgttctcgaacacatcgagatcggtgaacagcgcgccgctctggaacagcacgcccatctgcttgcgggcgtcgaacagatcgccgcgcgacaatttgggcaggttctggccattgacccagacttcaccgctgctgggacgcaattgcgcgcccatcaaccgcaggagcgtggtcttgccgcaaccggaaggccccatgatgccggtgaccttgccccgcggaatacggatatcgacattattgaagatgctgcgcgcaccgcgcttgaaggacagtcccttcagctcgaccgcgtaggcgttatcggcactcatctaaactccttgcgatgcagcctctcactcggacgcttggctccctgccgggagtacatgcacccagggcaggccgaactggcggcgaactatatcactgctgatacggagcccccaaggccgaagccatccgcattcaggatcacgacagcctaaaacaggctttacaggacaattcctgcctatagaaggacaaaggctgacgaacttgcgtgagggaatcgatcattaccgctataatcgccgccttttcatcaggctatacgatttctgacatgagccaatccagcgacctgattcaatcggcacaacgcaccatccgcctcgagatagaagccgtacaaggcttgctgccacatatcgacgcagatttcgtacgcgcttgcgagatgattctggccagcaaaggccgcgtagtagtggtcggcatgggcaagtccgggcacatcggcaacaagatcgccgccaccctggccagcaccggcaccactgcgttttttgtccatccggccgaagccagccatggcgacatgggcatgattacccgggacgacgtgatcctggccctgtccaactccggctcgaccaatgaaatcgtgaccctgttgccgctgatcaagcgcctgggcatccagttgatcagcatcaccggcaaccctgattcgccactggccaaggccgccgaggtgaatctcaacgtccaggtcgagcaagaggcctgcccgctgaacctggctccgacctcctcgaccaccgccgccctggtcatgggcgacgccctggccgtggcgctgctggaagcccgcggctttaccgccgaagacttcgccttctcccatccgggcggcgcgctgggccggcgcctgctgctgaaagtcgagaacgtcatgcatgccggcgagcaactgccgcaggtccagcgtggcacgttgctcaaggacgccttgatggaaatgacccgcaagggcctgggcatgaccgtcattgtcgaggccgacgggcgtctggcgggggtcttcaccgatggcgacctgcgccgcaccctggatcgcaccatcgacatccaccacaccactatcgatgaagtcatgaccgttcacggcaagaccgcccgcgccgaaatgctcgcggccgaagccctgaagatcatggaggacaatcgaatcaacgcactggtcgtagtggacaaggacgatcgcccgaccggcgccttcaacctgtccgacctgctgcgcgcgggagtcatgtaatgagcacggatctgctgcaacgcggcaagaacatcaagctggcggtattcgacgtcgacggcgtactgaccgacggtcgcctgtacttcctcgaagacggcagcgaattcaagaccttcaacacccttgacggccaaggcatcaagatgctgatggccacgggcgtgcagacggcgatcatcagcggccgcaagacgccggtggtcgagcgtcgggcgaaaaacctggggattccccatctgtttcagggtcgcgaagacaaactggtggtgctggacgggcttcttgcccaactgggcctaagctatgagcaggtcgcctacctgggcgacgacttgcccgacctgccagtgatccgccgggtcggcctgggcatggccgtcgccaatgccgccagttttgtccgtgaacacgcccatggcgtcacccaggcccgtggcggtgaaggcgccgcccgcgagttctgcgagttgatcctgcgcgcccaaggcagccttgaagcagcccacgccgcctacttatagagcctcccatgctgagcaaaaagattcgcaacatactgatcttcggcatcatcaccgtgctgttcctggcggtggggtactggaacatcagcccggaacgcttcctcgacaagccggtcgcgcaggtcgacgaaagcgccatcgactactacgccatcaacgcccgtagcgtgcagtacctgcccgacggcaagctgcagtacgaaatgacttccgacaaggtcgagcacctcaaggccaccgaggtgaccctgctgaccaagccggacctgcagatgtatcgcggcaccgccttcccttggcatgtccagagcgagcgcggcgaagtcaacccggacggcaccgaggtcgagctgatcgattcggtacgggtttcgcgcaccgacgagaaaaatcgcaacctgctgatcaccacgacccgcatgacagtattcccgcagaagcaatatgcgcagaccgatcaagacgttagaatcgacggcgccggcggcgtgacgactggcaagggaatgaaagcgtatttgaaagacggcaggatgaacctgctatcgaacgtaagaggacagtatgaggctcgttaaaaccctccctattttgctcggtctgggcgcagcactgggaagcgtgagcgcctgggctctgccgaacgatagccagcaaccaatccgcatccaggccgacgacgctcaactggacgacaagaatggcgtagccacctacaggggcgacgtgatcatcacccagggctcgatgaaggtcaccggcaataccgtgaccatcactcgcacccagaccggtgatatcgacgtggtgacctcggtgggcaacctggcctacttcgagcagattcaaacccagggcgacaccaagccggtccagggctacggtgtgaccatccagtaccacgccgcgcagaaccgcgtcgtactgatcgaccgcgccaaagtcgtcgacaaggacggcaacatcacccagggcgagaaaatcgtctacgacaccaacaagaagctggccagcgccggtcgcgccaccggcagcaaggtcaccgagtcgcgcccacggatcgacatggtcatccagccgaaaaagaaaactgacgagcaaaaggcccagtaatggcaactctgaaagctcagcacctggccaagagctacaagagccgccaggtcgtgcgtgacgtcagcctgtccatcgacagcggccagatcgtcggcctgctcggccccaacggcgccggcaagaccacctgcttctacatgatcgtcggtctggtccaggccgatcagggacgcatcctgatcgacgacctggatgtcagccaccagccgatgcacggccgcgcccgtgccgggatcggctacctgccgcaggaagcctcgatcttccgcaagctttcggtggccgacaacatcatggccatcctcgagacccgcaaggagctcgacaaggccggccgtcgccaggagctggaaagcctgctgcaggagttccacatcaaccacattcgcgacaacctgggcatgagcctttccggcggtgaacgtcgccgcgtggaaatcgctcgcgccctggccaccgcccccaagttcatcctgctcgacgaaccgttcgccggcgtggacccgatctcggtaggcgacatcaagcagatcattcatcacctgaaggccaagggtatcggcgtgctcatcaccgaccacaacgtccgtgaaaccctggatatctgtgaaaccgcctacatcgtcaacgacggtcaactgatcgccgaaggcgacgccgaaaccatcctcgccaacgagctggtcaaggaagtttacctgggccatgagttccgcctgtaagccctgaggtgtttggctggtcgccagagcgcccgccccaataaaaccctgccgtttttattgttacagcgctctaggcaaacacttcagtttcaggcatataatttgcttatgtttggcgctcacgcgccctgtagtggatggcgcatgtgcgccggcgaataaggtgttaagcccctgccatgaaaccatcgctagtcctcagaatgggccagcagctgacgatgacaccgcagctgcaacaggccatccgcctgctccaattgtcgaccctggacctgcaacaggaaatccaggaggccctggagtccaacccgatgctcgagcgccaggaagaaggcgacgacttcgataacaccgatccgctggccgacaacgccgagcagaaacccaataccgatatccaggaaccctcctaccaggaaaccgccccgacggtggacaacctcgaggacggcgaatggaacgaacgcattcccaacgacctgccggtcgacactgcctgggaagacgtctaccagaccagcgccagcagcctgcccagcaacgatgacgacgagtgggatttcaccacccgcacctcggccggcgaaagcctgcagagccatctgctctggcagttgaacctggcgcccatgtccgatactgatcgcctgatcgccgtgaccctgatcgactgcatcaacaatcagggctatctggacgaaaccctcgaggaaattctcgaagccttcgatccggaactggacatcgaactcgacgaaatcgaggccgtcctgcaccgtatccagcaatttgagcccgccggcatcggcgcccgcaacctgggtgagtgcctgctgctgcaactgcgccagctgcctgccaagaccccttggctgactgaagccaagcgcctggtcagcgacttcatcgacctgctcggcagccgcgactacagccagctgatgcggcgcatgaagctcaaggaagacgaactgcgccaagtcatcgaactggtacagagcctcaacccacggccgggctcgcaaatcgagtccaccgaagccgaatacgtggtccccgacgtcatcgtgcgcaaggacaacgaacgctggctggtggagctgaaccaggagtccgtgccgcgcctgcgcgtcaacccacagtacgccggcttcgtgcggcgcgccgacaccagcgccgacaacaccttcatgcgcaaccagttgcaagaagcccgctggtttatcaagagcctgcagagccgtaacgaaaccctgatgaaagtcgccacccagatcgtcgagcatcagcgcggcttcctcgagtacggcgatgaggcgatgaaaccgttggtcctgcatgacatcgccgaagcagtcggcatgcacgagtcgacgatttcacgggtgaccacgcaaaaattcatgcataccccacggggcatttatgaactgaaatactttttctccagccacgtaagtacctccgaaggcggtgaatgctcgtccacggcgatccgcgcgatcatcaaaaaactggtcgccgcggaaaatcagaaaaagccgttgagtgacagcaagatcgctggtttactggaggcacaaggcattcaggtagcccgtcgtaccgtcgccaagtaccgtgaatccctggggatcgcgccttccagcgaacggaagcggttgatgtagccgccgggctcgccacagcgttccagtggcaggtcaatcgacctgccgctttatgcactggcaacgaaggagaagctgtatgcaagtcaacatcagtggacaccaactggaagtgaccgaacctctgcgcgcttacatcggcgaaaaactcgaccgacttgagcggcactttgacaagattaccaatgtgcaggtaacgctggccgtcgaaaaactgaagcagaaaatcgaggccacgctgcacatccatggtggggaagtcgtcgccaatgcagaacatgacgacatgtatgccgcaatcgacttgctcacggacaagcttgaccgccaactgaaaaagcataaggaaaagcaactccaccttctccaaggcacgggtcgctaacactcccctcccatgatccgacttgaaagcatcctgacccccggccgttccctggtgaacgtgccgggcggcagtaaaaaacgcgccctcgaacaaattgccaatctgatcagccgcgaagtgcccgatctggagatgcaagatgtcttcgaaagcctgattgcccgtgaaaagctgggctctaccggttttggcaacggtattgccatcccacactgccgcctcaaaggctgtgagtcgcccatcagtgccctgatgcacctggacgctcccatcgatttcgacgccatcgacggcgcaccggtcgacctgctgttcgtactgctggtcccggaagccgccaccgatgcgcacctggaactgctccggcagattgctagcatgctggaccgcaaagaagtgcgcgacaagctgcgcagcgccaccagcaacgaagccttgtacaaggttgtcctggacgaacagaacggtcagtaatcatgcgcttgatcatcgtcagcggccggtccggctcaggtaaaagcaccgccctcgatgtactcgaggacaatggttattactgcatcgacaacctgccggccgggctgttgcccgaactggccgagcgggcgctgatccataccgaattgacacagccactggtcgccgtgtcgatcgacgcccgcaacctgcccagccacctgtcgcgctttcccgaactgctcgaggaagtccgcagccggcatatccagtgcgatgtggtgtacctggacgctgacgaagaaaccctgctcaagcgcttttccgaaacccgccgccgccaccccttgagcagcaacaatcgctcgctggccgaggcgatccaggacgaaagccacctgctgggaccgatcgccgacctggccgatctcaaggtcaacaccaccaacctgaacctgtatcaactgcgcgataccatcaagttgcgcctgttgaaccaaccggagccgggcaccgcctttctggtggagtctttcggattcaagcgtggcatgccggtcgatgccgacctggtgttcgatgtgcgctgcctgcccaacccgtactggaaacccgagttgcgcgcccagtccgggctcgaccagccggttgccgaatacctggccgcccagccggacgtcgaggaaatgttccaggacatctccagctacctgctgaaatggttgccccgtttcgccgccagcaaccgcgcctacgtcactattgccattggctgcacgggcggccaccatcgctcggtctacctgaccgaacgcttgggccaagtcctgcaaaagtccctgaagaacgtccaggttcgccaccgcgaccttagctgaaaggatctaccccgcgatgcctgctctggaaattgaaatcatcaacaaactgggcctgcatgcccgtgcctctgcaaagttcgtcggcgtggccggtcagtttccttgccagatccgcgcagggagaacgccggagtcgatggtcgacggcaagagcatcatggcaatgatgatgctggccgccggcaagggcaccaggattcatctgaagaccgaaggcgaacaggagcaggaggcgctggaagcgctggtggcactgatcaacaacttcttcgacgaaggcgagtaaggtcggcagggcaaacctgccgaaaggcactcaagcgagtgccgtatccatgaccatcatcaggcaaaagccgacacacaagcccaggctggccagcttctcatgaccgttgcgtcgggattcgggaatcacttcgtgggtcaccaccagcagcatcgcccccgccgccaacgccagcccgagcggcaacagcatctcggccaggctcaccagccacgcacaaagcaacgcgaacaccggctccaccaggcctgaagcggcaccgatcaggaacgccttgaccctggacatgccggcgccagccagcaccagggcaatcaccaggccttccggcacatcctgcaaggcaatgcccatggccaggctatcagcctccggcatgccgccacccgcggaaacgcccacggccattccttcgggaatgttgtgggcgatgatggcaaacacaaacagccagattcgcggcgggataaccggatgctcaagggtgcccaccagtttctccgggctgccccccgagactttgcggtccaccagaaacaaccccaaggcaccgagcatgatgccgaagctgatcaggccactcgaagcccagggcgacagtccgattttttccgccgcggcgatcccgggcacgatcaacgaaaaggccgtagccgccagcatcaccccggcgccgaatcccaacagggtgtcactcagcgccagcggcatcttgcgaatgaccaacactggcactgcccccagcgcggttcccagggcacagaccgccccaccctgcaatgcacgcaacaagcgcggctccaggtccagccaggacaagccctgggcaaccagcaatgcagtacccgccaacagcaacagcgaaccgaatgcgtaacgaaacatccgcccgctgccgatcgtcagtgtttcagtgcccatagtcagccttaggtctttttataggagggggctcaaaccagtgcggcctgatagcgctgggctacttcaggccaattgatcacgttgtagaacgcattgatgtattccggccgccggttctggtaacgcaggtaataggcgtgctcccacacgtccaggccgagaatcggggtattgccgttcatcaacgggctgtcctggttgccgctgctctcgacgaccagggtcttttgcggggtcacgctgagccaggcccaaccgctgccgaaacgcgtgagcgccgccttggtgaaggcctccttgaaactctcgaaaccgcccagctgctcgtcgatcgcctggcccagcgcaccgttcggcttgcctccgccgctcggcgccatcaccgcccagaacaacgaatggttggcgtgaccaccgccctggttgatcaccgctgcgcgcagtttctccggcagttgctggaccccggccaccagtttctccactgaccaatcggcccattcggtgccttccacggccgcgttgaggttgttgatgtaggtctggtgatgcttggtgtagtgaatctccatggtttgcgcatcgatgtgcggttccagagcgtcgtaggcgtagggcaatgcaggcaaggtaaaggacatatcaatgtgctccgtaatgaggggcattcggggtcgcggtgccggcagtcgattgcgcgacattgctctccagcaggcgatgcgtacgggggtattcaccgtgctcaccgatgaagttgagcaactcgacgtaagtcttgctgctctggcgcagcgcggcttcccgcagcgccggcgccaggcggctgtcctgcatggtctgcaacaaccgctgatggatggcgcagaggtactccgcgctctcctccggctggttcaggcgcaggtgcaggtccgccaggttgtgatgggagatgacacaggccgccaccgcttcgtcggcatcgctccagcgctcgaacagcacctgcgccagggccagggcctgcaagtaatactcacgggcatccaccaggtcgccctgcatgaagaaacggtttgccctttcgatcgtgcgtttccagtgctccatggtgaacctccaaagcgatgtcgggatttacacgccgcccgcggtgagtttttccgggtcgagcagaatctccagctggctgcgtgacagatcagtgtgttcaagggcgacatcgatcaccgggcgcccctgcttgtaggcggtcttggcgatttcagcggccttctggtaaccgatgatcgggttgagcgccgtgaccaggatcggattgcgcgacagcgcctccttgagcttgggctcgttgaccttgaagctggcaatcgccttgtccgccaacaggcggctggaattggccagcaactcgatgctgctcaacaggttctgggcgatgatcggcagcatgacgttcagctcgaagttgcccgactgccccgccaccgtgatggtcatgtcgttgccgatcacctgggccgccaccatcgctgtggcctccggaatcaccgggttgaccttgcccggcatgatcgaagaccccggctgcaagccttccagctcgatttcgccgaggccggccaacggcccggagttcatccagcgcaggtcgttggcgatcttcatcaaggtgaccgcaatggccttgagctggcccgagaccgccaccgcggtgtcctgggaaccgatcagggcgaacaggttcttgcctggggtgaactgcacctgggtcaggctgctcagctgccggctgaaacccgcggcgaactgcgggtgagcgttgatcccagtgcccacggccgtgccaccctgcgccagggattgcaggctcggcagcagatcctgaaggtgaccgatattggccttgagctgctgcgcccagccttccagcacctggctcatacgcaccggcatcgcgtccatcaagtgagtgcggccggtcttgatgaagggatgaacctcgaccgccttgcgctcgatgacgtgcaccagatgcaccagcgccggcagcagttgttcgtgcaagcccagcgcggcgctgacgtggatggtggtcgggatgatgtcgttgctgctctgtccgcagttcacatggtcgttggggttgaccggttcgccgagcaggcggctggccagggtggcaatgacttcgttggcgttcatgttggaactggtgccggatccggtctggaagatatccaccgggaaatgctgcatgaagtcgccttccagcaggccctgggcagcgtcgactatggccttgccctgggattcgctcagttgcttgagctcgacgttggccttggccgcggccgccttggccaggatcagcgcgcggatgaactgcgccggcatgcgctggtggctaataggaaagttatccaccgcgcgctgggtttgcgcgccatacagcgcctgctccggaacatgcagttcgcccatgctgtcgcgttcgatacgggtattactcatcgggaaatccttgcaccagttcgataaggggaatggatggcagcaacgagcaagtcgccagttgccaggcatggctttgccagcgcttgagccggcacttgcagaaagacaggcgttccaggtcacgcaacgggcgccaggcctggtccaggcactggctgcgccaatgccagggcagcgcggtatcggtggcggtatcgagcagcaggcggaatgaggtttcagcgatcagccagggcgaggtggcggtgcaacacgccagatagcgcccttcggccaggtaatgctcgatcagccgtggctcgtccggatcgagggcacaacggatctggcggctcatccagcgccagctttcgaggtaaggctgctcgtgcaaggcagaactcatgacctgggctcattcgataatgagatttattattatatgatattgagaatcaaaacaagaccgcgatccccctcccctttgtaggagcgagcttgctcgcgatcggctgcgtgccaggcaaaacgctatcgcgagcaagctcgctcctacagacagggcgattgataaacaaagaaaacccgggcaataaaaaaagcgcgcgccccggacgggacgcgcgctttggttgatgtcgtcgcagcttagctgccagcgaccatcatgcgttcgatcaataccgaaccggtgcgaatgttgctgcgcagctccagatcgttaccgacggcgatgatctgcttgaacatatcgcgcatgttgccggcaatggtgacttcctggacagcgaactggatttcgccattttcgacccagaagccggcgccccccgggaataatcgccggtgaccatattcaagccgtggcccatcaactcggtgaccagcaggccccggcccatgcgacgcagcaaggccgcctggtcttcctcgccatgggtcacgaacaggttgtgcacgccaccggcgttggcggtgctgggcaggccgagcttgcgcccggaataagtccccagcacgtaagacaccagttcgccgttctcgacgaaaggcttggcgtaggtagccaggccatcgccgtcgaaggccgagctgcccagggcgcgcatcaagtgcgggcgctcatcgatggtcagccattcggggaatagccgttgccccagtgcgccctcgaggaaggatgacttgcggtacaggttgccgccggaaatcgcccccaggaagctgccgaacaggccgccggccagttccgcggaaaacagcaccggcacttcgcaggtcggcaccgggcgcgcgcccaggcggctcgcagcacgttgcgcggcgcgctggccgatggtcaccgggtccgtcaacaggtggccctggcgattgacgtcataccagtagtcacgctgcatctggccgtcggcctcggcgatcatcacgcaactcaagctgtgccgagtcgacgcataaccgccgataaaaccgtggctgttgccgtatacgcggcagccctggtgggtgctcagggtggtgccgtcagcgctcttgatccggctgtcggcggcaaaggccgcggcttcacaggccagcgcccgttcgatggcttgctccggggtaatgtcccaggcatggaacaggtcgaagtccggcacgtcccgggccatcagggcggcatcggccaaccccgagctttcgtcttccgaggtgtgcttggcaatggccagggccgcggcgacggtttcgcgaatcgcctcgggaccactggccgaggtgctggccgagcccttgcgctggccgacatacagcgtgatgccaaaaccctggtcgcgattgaactcgacggtttccacttcccgctggcgaaccgaagtcgacaggccctgctccagagaaaccgccacttcgcaggcactggcaccctggcgcttggcctcggcgatgatctgctcgacttgttcctgcagtgccggcaaagcctgcgggccgacgctttgtgctgcactcatggttttctccactcaaattctgctttcggttaaggccttcgagcgaccgggccggacaagcggcccccgactggttatcatggcggcgtttctttgcggactgccaccatggttgattcttacgacgactccctcgatggggagaaaagcaaatcccaggtcaaacgcgagctgcatgctctggttgacctcggcgagcgccttacaacactcaagcccgacttgctgaacaaactgccgttgaccgacgctctgcgccgggccctggcggatgcgcccaagcatgtcgcccatatcgcgcgcaaacgccacctgcaattcatcggcaagctgatgcgcgatcaggacaccagcgcgatcctggtgctgctggaccaactcgacgcctcgactcgccagtacaacgaacgtttccatggcctggagcgctggcgcgatcgcttgatcgcgggcgatgacgcggtcctggaaaagttcgtcaccgactatccagaagcggatcgtcagcagctgcgctccctgattcgtcaggcccagcacgaggtggcccataacaagccgcctgcctccagccgtaaaatcttcaaatacatccgcgagctggacgagactcaacgcggcctgcgctgagcctcgactcgggtgggttgcccggcaactcacccgccgcttcacttcttaagcgcccgtgccacccacggtgatcgcatcgatcttcaaggtcggctggccgacacccaccggcaccgactgtccatccttgccacaggtccccactccactgtccagcgccaggtcgttaccgaccatcgacacccggctcatggcttccggcccgttaccgatcagagtcgcgcccttgaccggcgcggtgatcttgccgtcttcgatcagatacgcctcgctggtggaaaacacgaacttgccactggtgatgtccacctgaccaccgcccaggttggcgcaatagatgccttttttcaccgaggcgatgatttccgccggatcgctttcgccacccagcatgtaggtgttggtcatgcgcggcatcggcaggtgcgcataggattcgcggcgaccgttgccggtgcgggccacgcccatcaggcgggcattgagtttgtcctgcatgtagcccttgagcacaccgttctcgatcagggtggtgcattcggtcggggtgccttcgtcgtcgatgctcagcgagccgcgccgcccggccagggtgccatcgtcgacgatggtgcagagtttcgaggccaccatttcgcccatgcggccgctgtaggccgagctgcccttgcggttgaaatcgccttccaggccgtgacctaccgcttcgtgcaacagcacgccggaccagcccgaacccagtaccaccggcaaggtgccggctggcgcggggatggcttccaggttgaccagggcctggcgcaatgcctcacgggcgtaccccatggcgcggtcttcactgaggaaataacggtagtcggtacgcccgccgccgccatgaccgccacgctcgcggcggccgttctgctcgacgatcacgctgacgttgaagcgcaccaaaggccgcacatccgccgccaggccgccatcggtggaggccacgaggatgcgctcccagaccccggccatgctgacgctgacctgctggatacgtggatcgagagcacgggtcgcggcgtcgactcgcttgagcagctcgaccttttccgcgcgactgatgacttccagggggttgtccggcgcatacagctgggccacgtcctgggtggtaaaggcctgcacggtaccgttctgcccggcgcgggaaatcgagcgcgcggcccgggcagccaggccgagcgcttcgagggtgatggcattgctgtaggcaaaaccggttttctcacccgactgcgcccgcacgccaacgccctggtccagattgaagctgccttccttgacgatgccgtcttccagcgaccaggactcggaaatctgcccctggaaatacaggtcggcggcatcgatacccgggccggccagatcgccgagcacgccctgcaggctttccagggtcacgccaccgggcgccagaaggtgttcactgactgaagataacaacccgctcatatgctttacgccttaaattcgtcgttcttaagcaagtcgctgcgcgccttgcgagaaaaagcgccggtgactggccaccggcatgcgcgcccggatggacgcctgttcgctgctgtcgcgctcggccagcagcacggcctcgccttgatcctgctgcgccagcacccggccccaggggtcgacgatggccgcatggccgaaggtctcccggggtcccggatgaatgccgccttgcgccgccgccagcaggtagcactgggtttcgatggcccgggcgcggatcaatacgtcccaatgcgccgcgccggtcacggcggtgaacgccgaaggagcgctgatcagctccgccccggcggctcgcaattcgctgtacagctcggggaaacgcaggtcgtagcacacggtcaggccaacccgccccaccggtgtatccgccaccaccacctgttctccatgagcatagtcatccgactctcggtaacggccgcgattgtcggccacgtccacgtcgaacagatgcagcttgtcgtagcgcgccacttgctcgccgtgctcgtcgatcagcagcgagcaggcccgggccttggtctccggctggtccaccggaggcagcggcaaggtgccggccactatccataacttgaggtcgcgggcggcctgtttcaaccagggcaggatcgggccttcgccccgggcctcggcccgaccgatggccgccgcatcgcggcgccccatggcggcgaagttctccggcagcacggccaggcgcgcaccgccggcagcggcctgctccagcagttggcgcgcctgctgtagattggccagaacgtcgctctggctgaccatttgaatcaccgcaagggacatggcgcactccaggttggatatgtggccatgctactccataggcccgggccgcggtttttcaaaaaggtttgtcgaaggtgattttcggatccttccagggtcccttgacgctgtactggacgctggcgaagcgcgacacccggtcgccgatcagcttgtcgatcaggaacagcgccccgccgaccgccggcgcaccgacaatcagcgcggcgatcggcaggttgttggtcacgggcagcgtcaccaacagcttcgaatccacctggtcggccaccaggtccagggtgccattgagttccaggttactcgacggcccggtcagggtgatgggctcacgggtcacgtagacaccgttgctggccaccagcaaacccttgacccggtcgtagctcaggcccttgccgaacaggtcggagaagtccaggcgcaagcgccggccgatggaattgaagttcagcaggccgaatacccgcaaggcctgcgccccgccttcgacttccacgaactggcctttgcgcagggtcgcatccaggctgcccgagaaccgcttgagcccgacccaggccggcgacccgggccagcgcccgtccacatccatatggaactcttcgctggtcacggtcggcgcaaagccccagcccttgagcacgtccgccaggttcttgccgcccaggcggcccttgtaccaactggtggccgcgccgggttcgccttcccagccgccggagccttgcaggaccatgcccttgaggcccaggtcgaggctgttgaaagccatgcccttggcggtcgggcgcactttcagcgaccaggcgccgatcaggtcgttgccctggtacagctgtttgatcgagagatccagcgccgggactttcttcgggtcgaccgaagccagagggtccggcgcgttttcgtcggcctgcgccgtcggatcggcggccggtaggcgcacatactgcagattgatcgccatcggcgccgccttggcatcgggaatcgccacgttgcccttggcttgctggctgtcgagctgcagggcccaggaggacggcttgcgcgtcaactgcacacgggcctcgtccagggtggtgccgaaaccgctgagcttgccgaccctgaagtcggcgccactgagcagttgcttggcgctaccgcctgcatcctgcccggcataccgatcgaccagcaccttccacggctccacatccagttccgaaagcacaccgcgcacccgcaggcccttgccccccggcaacacggcatcgccttcgccgaggaacaactcgccacggccatcggcaaaatttccgctcggcgcggcgaaagtaaagttggccagatcgccataatcgaaccagtaacgccgctcggcgccctgcaaggtcatgcgcaatacgctgtcacgcccctggctcgccgccatgccgaaaggcgcaggcaagtcgacggcaacccccttgaggctggaactgaccatcagttggctgtccgcgccatcgaggttgagctgcagctggtagggaatgtcaccggaaaccggcagcggctggttgtatttcaaccactccgtgagcttcttgaccgacacctggcccttggcgacgacccgggtatcgagcttgccagggcggccgtcggcaaaaatctgtgcggtcaccgggcgctcgaaggcctgggcgctgatgccctggccgctcagccccttgctgctgtcgaagcggaaatcgcccttgagctggctcaattccagctccggttcgctcaacttgagccgtgccttgttggtcttgaagtccaccagcaccttcggttcttcgcccttgaccagcgggatatccagcttcagcttgccctgcaggtcgccatcgccctgccagccggcaaaggtcgggcccgtgccgatcggcgcttcctgaaggatcttcaagccatcgcccaggccgccggcgaactcgccgtcgataaacatgtgggtgctttgcccggcgggcacatggggaatattgacgtagacatccttcacctgggtgtcgagcaactgcccctggctggccaggatgcgcacaccgctgtcctcgatgaacacatcgccgctgaccttgccgatgtgcggccagcccggctggaaggccagctcggcatcgtgcaccttgaagaacaggctgatgctgcgcgcggtgtcggctgcgccatggttcagcgaaccctggtactggaagaaaccttcatccaccgcgcccttgaggattgccgtgcgcagccattcgtccagggctgggctgagcaccttgggcaggtacttggcggtataacgaccgtcgccatcgaccagcccgacccgcaggtccatatagtcttcctgggtgtgatcgaaatgcaggcggatcaggaagtcaccggcaatcttgccctcctcgcccaggaccttgaggtacggcgcgatcagggtgaacccctgctggtcgagcttccaggtcagccgggcattggcctgcaggtactgccagggcttggcgaagatcgggtccaggtgcaaggcaaagtccttgctgtccatgcgcagctcgccctgcccaaggtcgccgctgatgctgccgctgacgttacgggccgccggcgcgccgcgataggcgttgaacccgacctgctccaggttggcggcaaaactcaggcgctgatcgccgctgacctgcggccggaagtcgaacaggatgttgcgcagcgcgcccgtgaccttgaggttgtcgatgatggtcgcgaccttttccggcaacggcgcccaggcatccaggaccggcgtgatcggcgtcaggtcgaggcggtcggcctgcaagtgccagagttcttcggcactgttgacggtaccggtctgttgcaggtgcaggcgggactcccagcgcgtctcgccgatgttcatggccagcgagtcgaaggcgacgctgaggccctgctcgttgcgctggaaataggcattgagcgccaggttcttcacggtgaccggtttgcgcccgtcataggccccgctgacctgcggcgcgttcaggcgcgcgaccatgctctgcagcaggccatcgccccaactgagccagaactcaccaccggccttgagttcggagaacgtccactgttgggtcacgcgcggcggcagccatttcgcccagtcgctttgcggcaggctcaggtaggcgtcggcctgcccttcgcgccaggcgctggcgcggattcgcgtgcgcaagctgacagccaggggctgaccgtccggcagggtcaggcgcgcatccaggcgttgacggctggggccaacacgcagattgaggccgacataggtcaaggcaatcgcgggatgatcgagcggttgcagggtcacctggctgtcgatcaccgacagctcactgagcatctgcatgcggttgagcaactgctcggggtcgagaggctggttatcctgcaccggcaggccttcgagcgcccagcgcccatccggaccttccttcaggctcaggttgaggccgctgaattcaaggtgtttgacccgcagttggcgcgccagggcactgccgggcagatcgggcgccacccgcacctgatccaggcgcaaggcgttggcgccctcgccgactgtcacatcgtgggccagcaggatgggcgagaaaccgctccagctgccttccagccgaccgatctgcaccggcatgcccaaggcttcctgagccttggcctggacctcggcccgatattcagccaccagcggggtcagctcccgacccaggctgacgtacaaggccgtcagcaccagcagtaacgcacaaagccccagcccccaacgggtcagagcagcgagaaaacgcatcagacgctccatgtcagttggcccccgcggcaagagtcatgtgaaaaccggggccagctgtatccggtaaatgtagggtacgcggactcagagcagcaccacgtcgtattgttcctgggaatacatggtttcaacctgaaaacggatggtccggccgataaaggcctccagctccgcgacgttgcccgactcttcgtcgagcagccggtcgaccactttctggttcgccaggacccgataaccttcggcctgataggcccgcgcctcccgcaggatttcccggaagatttcgtagcagatggtttccggggttttcagcttgccgcggccctggcagctgctgcagggctcgcacagcacctgctcaagactttcccgggtacgcttgcgggtcatctgcaccaggcccagctcggtaatgccgatgatgttggtcttggcgtgatcgcgctccagctgtttctccagggtgcgcagcacctggcgctggtgttcttcatcttccatgtcgatgaagtcgatgatgatgatcccgcccagattgcgcaggcgcagctggcgggcaatagcggtcgccgcttcgagattggtcttgaagatggtttcttcgaggttgcggtgaccgacgaaagccccggtattgacgtcgatggtgctcatggcttccgccgggtcgaccaccaggtaaccgccggacttgagcggtaccttgcgctcaagggccttctggatttcgtcttcgacgccatacaggtcgaagatcggccgctcgcccggatagtgttccaggcgatcggcgatttccggcatcagttcggcgacgaactgcgtggttttctggaaggtttcccgggaatcgatgcggatcttctcgatcttcgggctgaccaggtcgcgcagggtacgcagggccaggcccaggtcttcgtaaatgacactgggggcgccgatggtcttgatctgcgcgccgatctgatcccacaagcggcgcaggtaacggatgtccatcatgatttcgtcggcgcccgcgccctcggcggcggtacgcaggataaaaccaccggcttccttgatgccttcctgggccacgcaatcgctgaccacctgtttcaggcgctcgcgctcggcttcgtcctcgatcttcagcgagatgccgacatgagcggtgcgcggcatgtacaccaggtagcgcgaagggatcgacagctgggtggtcaggcgcgcgcccttggaaccgatcgggtccttggtcacctgcaccaccaggctctgcccctcatggaccagggcgccgatgctttccaccgccggcccttcgcgcagggagatttccgaggcatgaatgaatgccgcgcgatccaggccgatatcgacgaacgccgcctgcatgccgggcagaacccggaccaccttgcctttatagatattgccgacaatcccgcgacgctgggtccgctcgacatggacttcttgcagcacaccgttttcgaccaccgccacgcgcgactccatcggcgtgatgttgatcagaatctcttcactcatggcagggtctcgttcaggcatattcactatggatggccgcatcggtaggtacggcgcttagcgcactgcaaggttttgccaacagggtatgccgaaatggccaagtagttctgcggtttcgcataccggcaagccgacgacagcggaataactgccattgagccctgccacgaataccgccgcaagcccctggatgccatagccgccagccttgtcgcggggctcgccgctggcccagtagcgggccgcctcgtcatcgccgatcgcccggaagcgcaccaggctgcggaccacccgcgactcgcagcgctggccatcgagcacggcaatggcggtcagcacttcatgttcgcgccccgacagggccatgagcatcgactgcgcatcggcctggtccagcggtttgcccaggatctgcccatcaaggaccaccgcggtgtcggcgcccaggacacaggccgcagactggccatcggcgatcagcgcatacccggccgccgccttgtcgcgcgccaggcgctcgacataggccgctgggttttcatcggggagaggggtttcatcgatatccgcgctgatggcggtaaaaggcacaccgatctgcgtgagcagttcccgtcgacgcggcgagcctgaagcgaggtaaagcgatttcatcaagacatctccctgtcgaggtacgggcaaatgcctgaccgaatcagttgattttgaaacgtcggcgcaacccgcgcaaaccgaagctgacccaaggccagagcaaggcactgaccaatgccggcagcaccagtgcaagggtcggttgacggttgccggtcaaggcgctgagccacagctggaccagttgcgccaggccgaagatcaccaggatcaccaggctttgctgccacatcgggaacatgcgcaagcgctgttgcaacgacagcaccaggaaggtgatcagggtcaggatcagtgcgttctgccccagcaacgtgccgtacagcacatcctcggccagccccaggcaccaggccgtgaccatgccgaccttgtgcggcagggccagggcccagaacgccagcagcaaggccagccagagcgggcgcaggatttccatgaattgtggcaaaggcgacacgctgagcagcatgccgatggcgaaggtcagccagaccatccagccgtttcgggacattattctcttcctcccgtggaggccggggccgctgcaggcggcttgggcgcggcgggtctggtggcggcgggcttgaccggagccggatgggccacgggcttgaccggcgtcgtggcggctggcgtcgcgggtgcagcggccggtgcggcaggaacggtcgcggtggccggcgtcacgggcacgacaggcttgggcacggtcgccgggaccaccggcgtggcggtgccgccctgctggtcctgcgcttcctgagcctgggcggcgtcgttggcacgctcttcggcggtacggttatcgctgaacaccagcaacaggtaacggctgcggttcaaggcggccgtcggcacggcgcgcactatggcaaacggctggccggagtcatggatcacttccttgaccgtcgccactgggtagcctgcggggaaacgctggcccaggccggaactgaccagcaggtcgccttccttgatgtccgcagtgtcggctacatggcgcagctcaaggcgctccgggttgccggtaccgctggcaatcgcccgcagaccgttgcggttcacctggacaggaatgctgtgggtggtgtcggtgagcagcagcacgcgggaggtataaggcatcagctcgaccacctgccccatcagaccacgggcatcgagcaccggttgcccgagcaccacgccgtcgcgctcacccttgttgatgatgatgcgatgggtgaaggggttggggtccatgccgatcagctcggccacttcgaccttctcgttgaccagcgcggaggagttgagcaactcgcgcaggcgaacgttctgctcggtcaaggcggcgagcttttgcatgcggccctggagcaacaggttttcggtcttgagtttttcgttttcggcgaccagttcagtgcggctgccaaactggctggccacaccctgccatagccgttgtggcaggtcggtgatccagtaggactgcatcagcaccagcgacatttggctacgcactggcttgagcagtgtgaagcgggcatcgaccaccatcagcgcgaccgatagcacgaccagcaccaacaggcgtacgcccaatgaggggcctttggcgaaaagcggtttaataagccgctcctcccaggcaaatgttctctttattcatacggcttcaaaccggcctggagcagaatgacagaagataaacgccaacaggcagcactgcaaagtgctgcctgcgagcggaacacatggatgcacccggcgcgattattcgctggagagcaggtccatggtgtgtttgtccatcatttccaatgcacggccaccgccgcgggctacgcaggtcagcgggtcttcggcgacgatcaccggcagaccggtttcctgggccagcaacttatccaggtcacgcagcagggcgccaccaccggtcagcaccagaccgcgctcggcgatgtccgaagccagttccggaggcgattgctccagcgcgcttttcacggcctgaacgatggttgccagggactcttgcagagcttccagcacttcgttggagttcagggtgaatgcgcgtggcacgccttcggccaggttacggccacgaacgtcgacttcacggacttcgccgcccgggtaggcagtaccgatttcctgcttgatgcgctcggcggtggattcgccgatcaggctgccgtagttgcgacgcacgtaggtgatgatcgcttcgtcgaaacggtcgccgccgacacgtacggattcggcgtaaaccacaccattcagggagatcagggcaatctcggtggtaccgccaccgatatccacgaccatcgaaccgcgggcttcttcgaccggcaggccggcaccgatcgcggccgccatcggctcttcgatcaggaacacttcacgggcaccggcaccgagggccgattcacggatggcacgacgctcgacctgggtggacttgcatggaacgcagatcagcacacgagggctgggctgcagaaaactgttttcgtgaaccttgttgataaagtattgcagcatcttttcgcagacactgaagtcggcgatcacgccgtccttcatcggacgaatggcagcaatgttgcctggagtacgaccgagcatgcgcttggcttcggtaccgacagccacgacacttttctgattaccgtgggtccgaatggccacaaccgatggttcattcaggacaataccgcgctcgcgcacgtaaataagggtgttggcagtgcccaggtcaatggaaagatcgctggaaaacatgccacgcagtttcttgaacatgggaaagggaccctaggcaacgcgtgggtaaaaaagtgcggcaaactctaacaacgacagggattttgggcaaggcgccaatatgttaaattggccgcttttctgtgcaccaacccccacaatcgcggccttatgaccgtagaaatgcggtagtgttccgacaatctaacacacggacgagatccgttctgttttccactggagaatcccatggcgcttgaacgctccgacgtggaaaaaatcgctcatctggccagccttggcctcaatgaagccgatcttccacacatcacctccgacctgaacagcattctcgggctggtggatgcaatgcaggcagtcgataccgacggtatcgagcccctggcccacccgctggaagccagccagcgcctgcgcgcagacgttgtgaccgagtccaatcatcgcgaggcctatcagtccatcgcaccagcggtcgaaaacggcctgtacctggttccgaaagtcatcgactaaagggaaagagcctgcaatgcatcacatgaccctggccgagatcgcccgcggactcgccgacaagaagttttcctccgaagagctgaccaagaccctgctggcgcgtatcgcccagctcgacccgcagctcaacagcttcatcagcctcaccgaagatctcgcactgcagcaggccaaggccgctgacgcccgtcgcgcgaacggtgagagtggcgccctgctcggcgcgccgatcgcccacaaggacctgttctgcacccagggcatccgcaccagctgcggctcgaagatgctcgacaatttcaaggcgccctacgacgccaccgtggtcgccaagctggccgccgccgggaccgtgaccctgggcaagaccaacatggacgaattcgccatgggctcgggcaacgagaccagctattacggcgcggcgaaaaacccgtggaacctggaacgcgttccgggcggctcgtccggcggttcggcggccgcggttgctgcgcgcctgctgcctgccgccaccggcaccgacaccggcggctcgatccgtcagccggctgcattgaccaacctcaccggcctgaaaccgacctacggtcgcgtttcgcgctggggcatgatcgcctacgcctccagcctcgatcagggcggcccgctggcacgcaccgccgaggactgcgcgatcctgctgcaaggcatggccggcttcgacccgcaggactccaccagcatcgacgaaccggtaccggactacagcgccagcctcaacggctcgctgcagggactgcgcatcggcgtacccaaggaatacttcagcgccggcctcgacccgcgcatcgccgagctgattcacaacagcgtcaaggagctggaaaagctcggcgccgtgatcaaggaaatcagcctgccgaacatgcagcacgccatcccggcgtactacgtgatcgcgccggcggaagcctcctccaacctgtcgcgtttcgacggcgtgcgcttcggctaccgctgcgagaacccggcaaacctggaagacctgtacaagcgctcccgtggcgaaggcttcggcagcgaagtgcagcgccgcatcatggtcggtgcctacgccctgtcggccggttactacgacgcctactacctgaaggcccagaagatccgtcgcctgatcaagaacgacttcatggctgcctttaatgaagtcgacatcatccttggcccgaccacgccgaacccggcctggaaaatcggcgacaagagcagcgacccggtcgctgcgtatctggaagacgtttacaccatcaccgccaacctcgcgggtctgccgggcttgtccatgcccgccggcttcgtcgaaggcttgccggtcggcgtgcaactgctcgccccgtatttccaggaaggccgtctgttgaacgttgcccaccagtatcagttgaacactgactggcacacccgcacaccaaccggcttctgaggagaaacacatgcaatgggaagtcgtgatcgggctggagattcacacccagctcaccaccaaatcgaagattttctccggtagctccaccgccttcggtgccgagcccaacacccaggccagcctggtggacctgggcatgcctggcgtactgccggtgctgaaccaggaagcagtacgcatggcggtcatgttcggcctggccatcgacgccgagatcggccagcacaacgtgttcgcccgcaagaactacttctaccccgacctgcccaagggctaccagatcagccagatggaactgccgatcgtcggcaagggccacctggacatcccgctggaagacggcacggtcaaacgcgtcggcatcacccgcgcgcacctggaagaagacgccggcaagagcctgcacgaagagttcaacggcgccagcggcatcgacctgaaccgcgccggcaccccgctgctggaaatcgtttccgagccggacatgcgcagcgccaaggaagccgtggcctacgtcaagtcgatccacgccctggtgcgttacctggggatctgcgacggcaacatggccgaaggctccctgcgttgcgactgcaacgtctcggtacgccccaaaggccaggccgagttcggcactcgctgcgagatcaagaacgtcaactcgttccgcttcatcgagaaagccatcaactcggaagtccagcgtcagatcgaactgatcgaggacggcggcaaggtcatccagcagacccgcctgtacgacccgaacaaggacgagacccgtccgatgcgcagcaaggaagaagccaacgactaccgttacttccccgacccggacctgctgccggtggtcatcgaggactcgttcctcgaccaggtacgcgccaccctgcccgagctgccaccgcagaaacgcgagcgcttccaggaacaattcggcctgtcggtctacgacgccagcgtgctggcctcgagccgcgaacaggcggactacttcgagaaagtcgcgagcatcgccggtgatgccaagctcgccgccaactgggtcatggtcgagttgggcagcctgctgaacaagcagggcctggaaatcgacgaggcgccggtctcggccgagcaactgggcggcatgctgctgcgcatcaaggacaacaccatctccggcaagatcgccaagaccgtgttcgaagccatggccaatggcgaaggcagcgccgacgaaatcatcgacaagcgcggcctcaagcaagtcaccgacaccggcgccatctccgccgtgctggacgaaatgctggcggccaacgccgagcaggtcgaacagtatcgcgccgccgatgaagccaagcgcggcaagatgttcggcttcttcgtcggccaggcgatgaaggcttccaaaggcaaggccaacccgcagcaagtgaacgaattgctgaaaagcaaactcgaaggctgactgcagtgttgatggcggagttcgaatattccgcccctgtaggagcgagcatgctcgcgattgcgttgtttcagacaggacgctatcgcgagcatgctcgctcctactcttgtatctggggtcccgtattgatgaaacgcttgctgggctgcctggcccttttctcactcctggccggctgcgccagccatgtcatcgatccgcggggttacgacaagaccggcgtcgcctcctattacggcgccaagcaccatggcaaacgcaccgccagcggcgaacccttcaaccagcacggcatgaccgccgcgcaccgcgagctgccattcggcacccgcgtcaaagtcaccaacctcaataacgacaagagcgttgtggtccggatcaacgaccgcggcccgcatacccgtggccgcctgatcgatttgtcgcgtgccgccgcgcaacagttgggtatgatcagaagcggcaccgccaaggtgcgcgtgcaagccatcagcgactgacccacggagccctgatcattttcggattaaccgatttaccgctgctcagcgtccttcaattgttcagcggcctggtcctgctggtcgccggcgccgaattgctggtacgcggcgcggtccgcctcgccgcccgcctgcgcgtacgagcgctgatcatcggcctgagcatcgtcgccttcggcagcagcgccccgcagatggccgtcagcctgcaagccaccctggcggaaaacaccgatatcgccgtcggcagcgtgatcggcagcggcatcttcaacatcctggtgaccctcggcctgtccgccctgatcattccgctgcgggtatcgcgccagctggtgcggctggatatcccgttgatgatcctcgccagcctgctggtgttcaccctggcctacaacgaagaactgacgcccctcgacggcctgatcctgctggcgaccctgatcctctacctgggtttgctgctgcgccagtcgcggcactcggcgcgcccacagtcccagcaaggttccgacgcaccccgcgcgcactggctgagcagcctgctgtggatgatcggcggcctgctcctgctggtgttcgccggccatctgctggtcgaggcggcggtggaagtcgccaccgacctggggctgtccgagcgcatcatcggcctgaccatagtcgccgtcggcacctccctgccggccctggccacctcgctgatcgccgctttgcgtggccagcgcgacattgccgtgggcaacgtcatcggcagcaacctgttcaatctactgggggtcctgggtttcaccgccctggtggcgccgacgcccttgtcggtatcgcccaatgccgtggacttcgacctgccggtcatgctcggcgtcgcggtgctgtgcctgccggtgttctattcgggttatcgggtcacccgcgccgaaggcctgctgtttctcggcctgtacctggcctatgggctgcacgtggtgtccttcaccaccggcatgccgctggccggcaagctggaaaacctgatgctgttttacgtcctgccagtgctggtggcgttcctgctgttcagttcgctgcgggcctggcgccgccaacataaaaaaggggaagcgcaatgaccgagaataaaaagcagggcgtggaaatgcgccgccaggtgatgggcgatgcctttgtcgatcgcgccctgggcaatgccaccgagttcagccagccgctgcaggacttcgtcaacgaacatgcctggggcggagtctggaaccgcgaaggcctgccgctgaaaacccgcagcctgatcaccctcgccgccctgaccgcgctcaagtgcccgcaggagctcaaaggccatgtccgcggcgccctgaataacggctgcacggtggaagagattcgcgaggcgctgctgcattgcgcggtgtatgccggcgtaccggcggcgatcgacgcgttccgcgccgcccaggaagtgatcgacacttaccagaagcccgagtgatctgtagcgaggcttgcccgcgatagcgacctgcccgacacaccgctattgcgggcaatcgagcgtcgaccggccgctcctacaagagcactagatccacccgccccactgcagcagaaagatcccgatattggtggtcaccgccgccatcagcgtggtgatgacgatgattgccgccgccagctgatgattgccattggccgcccgggccatgacaaaactcgccgccgcagtcgggctgccgaaatacaggaacagaatccccagttccgccccgcggaatccgcagagccaggcccccagggtggcgaggatcggcaggccgaccattttcaccaggctcgaactcaaggccaggtcgccgctctcgcgcagcgccgccagggacagggtgccgccaatgcagatcaaggccagcggcagggtcatctgcgccaggtactgaccagacgtctccagccaggtcggcaggccgatctggaacacggcgaaaggcgctgccgccaggacactgatgatcaacgggttgctgaccacgcttttgcagatgctccacggatcggacttgatcaccgggctgtacaccgccaggacgatggtcgacagggtgttgtagaacaggatcaccagcgccgcgagaatcgccccgagggaaatcccgtagtcgccatacatgctggccgcgagcgccaggccgatgaccccgttgttgccgcgaaaggcgccctgggtgtagatgccgcggtcttcccgcgggcagcgccagatcgcccagccccaggcgaaggcaaagctggccagggtggccacggcgaaatagatcagcagcccgggcttgagcgccgaatgcaggtcggcgtggagaatcccgagaaacagcagcgccggcatggtgacgttgaacaccagggccgacgctgtgtggataaaaccgtcgttgatccagccgatgcgcttgagcagcacaccgagaaacaacatggcgaataccggcgcggtgatattcagcgtttcgagaaaaatggccagcatgccgggtcaaccttgaacctgtcgttaggcggctaatgataagccagcccgcgcgcttaagcccgatggatttgcccggaccgcaagtcgatccatcgggccgcaggcgttcgcggccatcaaaggccacgcccgcgatgcggtcgatcgcagcctgcggcagcggctacagggtttgtgtcgggctcggttgattggcaggtcgcaatccgggtagccgctgccgcaggctgcgatcgacccgaaggggcgctggcgtactcagccacgctggatatcgcctcctgcagcaaccattacggctcaggtaatcggcgccggattgaacaaggtgatgtcgttgtgcagcttgtgccgttcggcccaggtctgctgcttgccactggccacgtccaggtagaagtggaacagctcccagcccagctcttcgatactcgcccgcccggtggcgatgcgcccggcgtcgatgtcgatcaggtccggccagcgctgggccagttcggagcgggtcgagaccttgaccaccggcgccatcgccagcccgtaaggcgtgccacgcccggtggtgaacacatgcaggttcatccccgccgccagctgcaaggtgccgcaaacaaagtcgctggctggcgttgcgcagaagatcaggcctttgcgggtaaagcgctcgcccggccccaacacgccattgatcgcgctgctgccggacttgacgatggaccccagggacttctcgacgatgttcgacaacccgcccttcttgttgcccggcgtggtattggcgctgcggtcggcctcgcccttggccaggtagcggtcgtaccagtccatctcgcgcaccagctcccgggccacttctgtggattcggcgcgggaagtcagcagatagatggcatcgcgcacctcggtgacttcggaaaacatcaccgtcgcgccggcccgcagcaacaggtccgaggcatagcccagggccgggttggcggtgatcccggaaaaggcatcgctaccgccgcactgcataccaaggaccagttccgaggccggcacggtttcccgtcgccgctgatcgagcttctgcaaacgcacctcggccagctgcatgatctgctcgatcatctcggtaaaaccgtggctggagtcctgcaggcggtacagccagggctcgctgaggtccaccgagctgtcgccttcgtgcatcacctgcccggcctgcaacttctcgcagcccaggctgattaccagggcttcgccccccaggttcgggttacgcgccaggttgcgcacggtgcggatcgggatataggcatcagtggcggtgatcgccacgccgcagccatagctgtgggtcagcgccaccacatcgtcgacatggggatacctgggcagcagttcgtccttgatgcgcttgaccgcatgatcgagcaccccggccacgcactgcacggtggtggtgattcccagaatgttgcgcgtgccgaccgtgccgtcggcattgcgataaccctcgaaggtaaagccttccagcggcgcctgggccgccggcacttcagtggacagcggcaggctgtccagcggcggcgcgctgggcatgcgcaactgctcttccctgacccagctgccgcgcaggatcggctgcaaggcataaccgatggtctggccgtagcggatcaccaggccaccttcggcgatatcctccagcgccaccttgtggctctgggggacgaagtccagggtcaccaggccgtcggcgaacgccgtgcctgccggtacgccctggtcattgaccacaaccaccacgttgtcccgctcgtgcaggcggatgtagcgcggcgaatcggaatgttcaatcaactgcatgacgccgccccttcaggaatgcgcttgggaaagttgggtcagctgggggccgttgcttggtggttccttgagcaccacgcgcttgatcgggccgacgatcaccagatagctgaacactgccagcagcgcgttgcagccgacgaacaccaacgcccatttgaacgagccggtggagctgatgatgtagccgatgacgatcggcgtggtgatcgacgccaggttgccgaaggtgttgaacaggccgccgctcaagccggcgatctgcttcggcgaagtgtcggacaccaccgcccagccgagcgcgcccacgcctttgccgaagaacgccagggccatgaaacccaccaccatccattcgatgtccacatagttgcaggccacgatgctgctggagaccagcaggccggcgatgatcggcgccttgcgggcgaaggtcaaagaatgccccttgcgcagcaggtagtcggaaatcaccccgccaagcaccccaccgataaagccgcagatggccggcaaggaggcgatgaaaccggccttgagaatggtcatgccacgctcctgcaccaggtacaccgggaaccaggtcaggaagaagtaagtgatgccgttgatgcagtactggcccaggtacacgccaagcatcatgcgattggtcagcaactggcgcaggtagtcccatttcgggccgtcgctgcgtttgcctttgccgtcctggtccatgtcgaccatgccgccattgtcggcgatgtgtttgaactcggcctcgttgatcagcgggtgctggcgtgggctgtagatcaccttgagccagaccagcgagaagacgatgccgatcgcgcccatcacgatgaacacgtgctgccagccgaagtgatagacgatccagcccatcagcggggcgaacagcaccgtggcgaaatactgcgccgagttgaagatcgccgaagccgtaccgcgctcggcggtggggaaccaggccgcgacaatccgcgcgttgccggggaaggacggtgcctcggccagccccaccaggaagcgcagcatgaacagcgccaccaccgcggtggaaacgccgaactcaccgacataaccctgcagcacggtgaacagcgaccaggtgaagatgctcagggcatagatttttttcgagccgaaacggtcgagcagccagccgccggggatctgccccgctacataagcccaaccgaatgcggagaagatataaccgagggtgacggcgtcgatgccgaggtctttttgcaggctggagcccgcgatggcgatggtggcgcggtcggcatagttgatcgtggtcaccaggaacagcatgaacaggatcaggtagcggacgcgagtcggcttggtcgcttgcatatggatgtactcccactagttatttttatgcgggtaaaacatgcgtttcatcgaccccgccgggcctcaggcaacggccggcgggggtacagcgggacttaggatccgatgtaggaagtcttcaccacggtgtagaactcctgcgcgtagcgaccttgctcgcgggaaccataggatgaacctttgcggccaccaaaaggtacgtggtaatcgacgccggccgtcggcaggttgaccatgaccatcccggcctgggaatggcgcttgaagtggttggcgtatttcagcgacgtggtggcgatgcccgccgacaggccgaactcggtgtcgttggccatggccagcgccgcctcgtaatcagccacccgtaccacgttggccaccgggccgaagatctcttcgcggctgatgcgcatcgaagcctggctgtcggcaaacagcgtcggcgcgaggaaatacccctcggtatcgcaagtcaccaggccgccgccgctgaccagccgcgccccttcggactggccgatatcgatgtatttcaagtcctgttcgagctgcgcctgggacaccaccggaccgatatcggtgccggcccgcagcgcgtggccgaccttgatcgaacccatgcgttcggccatcgccgcgacgaaccggtcgtggatgcccgcggtgacgatcagccggctggaagcggtgcaacgttgcccggtggaatagaaggcactctgtaccgccagctccaccgcctgcttgaggtcggcatcgtcgaggatgatctgcgggttcttgccgcccatctccagttgcaccttggcctggcgcgagacgcagctgacggcgatctgccggcccacgcccacggaaccggtgaagctgatgccgtcgactttcgggctgttgaccagggcatcgccgaccagccggccgctgcccatcaccaggttgaacaccccggccgggaagcccgcgcgggagatgatttccgccagggcccaggcacagcccggcaccagctcggcgggcttgagcaccacgcagttgccgtaggccagggccggggcgatcttccacgccgggatggcgatcgggaagttccacggggtgatcaggccgaccacgccctgggcttcgcgggtcacttcgacgttgacgcccggacgcaccgacggcaggtaatcccctgacaggcgcaggcattcgccggcaaagaacttgaagatgttgccggcgcgggtcacctcgccgatggcttcgggcagggtcttgccctcctcccgggccaacagggtgccgagctcctcgcggcgggcgaggatctcgctgccgaccttgtccagggcatcgctgcgcgcctggataccggaagtcgaccaggccgggaatgcatcgcgcgccgcatcgatcgcggcatgcacctgagccaggtcggccttggcgtattcgccaatgacatcggacaactcggacgggttgatattggtcgagtagtcggcaccggcaagccattggccaccgatgtagttatcgaagcgttttacctctgccacgcgccctctccttacataaaagccttacgcaaaaggccgctgattgctcagcggccccggggatggattactgcgcgccctgggcgtcgatcaacgccgccagcgctgcatattcttccggcaacaggtcggtcaacggcgcccgcaccgggcctgcgtcatggccgacgatgcgggctccggccttgacgatgctcaccgcataaccggccttgcggttgcggatatccaggtaaggcaggaagaagtcgtcgatgatcttgccgaccgtggcgtgatcttcccgggcaatggcgtggtagaaatccatcgcggttttcgggatgaagttgaacaccgccgaggagtaaaccggcacgccgagggccttgtaggccgcggcgtagacttcggcggtcggcaggccgcccaggtagctgaagcgatcgccgaggcggcgacggatcgacaccatcagctcgatatcgcccaggccgtccttgtagccgatcaggttcgggcagcgctcggccagacgctccagcagcggcgcggtcaggcggcagacgttgcggttgtagaccaccacaccgatcttcaccgatttgcacaccgcttccacatgagcggcgaccccatcctgactggcttcggtcaggtagtgcggcagcagcaacaggcccttggcacccaggcactcggcctcctgggcgtattcgatggcctggcgggtcgagccgccgacgccggccaggatcggcacgctgctggcgcaggtgtcgaccgcagtcttgatgatttccgaatattcgctggccgccagggagaaaaactcaccggtgccgcctgccgcgaacagcgccgaggcgccgtatggggccagccattccaggcgcttgatatagcccgcgcgatggaaatcgccctgggcgttgaaatcggtcaccgggaaagacagcaggccggaggagaggatggacttcagttcttgtggattcattattcgaacaccctgggacgcacattgtgatgaaaaacacatcagccttggctgaagttgtaagtcatcgtataacttaaaaaacaatcgtcaacagcaattcgtcagccatcgccaaaatacgcggcaaaaaatacctgcttgacgagtcaggtttttgctttatgctcgcaaacaactgtatatacatacagttaatttcttgaaatacctacgacatatcaaggagctagaaatgtcaggtctacacactcagcagcgggaacagctgcagcacaaaagccaggtcgtcgccgatctggacagccttttcagcgaacgcggcattgccatttccggtgatggcgaccacctggtgctgatcgccgacggtcatcacaccatcaagtatcaccagcccgggctcctccccgcggcaccgggaaaaaacctcaaggccctgccccagctgcgtttcgagggtggcgagcacaccgccatcggcgatgccaccctgctgcgtttcgtcaaggacgcccctggcgttccagcctggcaggtcgaattgcacctgcccaatggcctggccctgacctacggccaggtggtggcgctgggtggcgatttctatggcatccccgaccagccgatctgcgaaggcgcgacgccggtggatcgtttgcagcgttttaccgccgcgttcaactctctcgccgtgttgccggcggccaaggacgaggcgaaacagattctcgcggtaatgcagaaggaaatcgccgccgccaaccaggcgctcaaggacggcaggcagcctcatgaggcctatgacgccctgggagatacgttgtccgaagagtggaacaagatcaccggcggcggcagcttcgcctcggcgctgttccccctgggccgctacctgaagctggcggccaacaatgccgaccatttcggcgagtgggcgctgctggcctatatcgccgggcacaccgcggccctgcagcaggctgtagtggcgcacaagaacgccgacgagaagcagctggaactggcctacgccatgaacgccttcgccgatcacttcctcaccgacctgttctccgccggccatgtgcgggtaccgcgcaagcaactggcggcggtggtcacgccgagcgatctcggttcgctgatcacccgcttcatgcacgacgaggacagcaagttcggcctcaacgtcagcaacgcccagggcgaccgctggcatgcctatggcgacaagcgttatttcgacaccctcgacagcaacaaccgcaagcaggtcaaactggccgtgcaacgctcggcggacgaaatcttcgaaagctacctcagcggcgcggccccgacgcccggcaacttcacggcgctgaagctgttgccggacctgaacgcggcgaagagcggcaacttttcaccgctgttcgtgatgcagggcgacaaggtgctgcgacgcagcgacgtgaacaacctgaacgacaccaagaccatcgacaactggtggggctggagcacctacctactgctcaaggactacaagcccaacaagccggcgggctacctggaagcaccgacgcttgccccgagcatccagaccgatggctggcagagccagacacccagcgaacccaactggctgcccggcaatgccgtgcgttatgccttcagctacaccaacggtttgaacgagtcgtacatcggcccgtggtccgcctacgccgaactgagcgagcgcttccagccgaccctgaatgtgccggtggacaccagcggcggttccagcgggcgcaacattttccgccagttccgcggtggctcgccggagctgatcgcctcgatcgacaagaccgccaccacttacatcgaccgcaatgcctgataaggacatcgacatggctatcaatctgactctagaactggcctcgggccaatccctgcagggcgcgcccctggaactgctggtcaacggcgctcccgtcgcgcgggcaaccgtcgaccagcaagggcatgtgaccttcaatgtcaaacccggcgccgggcaactggccgtgagggtggatcgctcgattctcaaaaaccgctaaaagcatcgcgggcaagctcgctcctacagggtcacctcccctccctgtaggagcgagcttgctcgcgataagaacccaagggcgacgcaataaccgccccaaccgcattacccgcgctgcgcctctgcctcttcatgggcatggcgcagccgttcgcggctgttggtcaggtgcagacgcatggccgcccgggccgcgtccgaatcctggcgggcaatggcttcatagatttcttcatgctcgcggctcaggcggctcatgtagtgctgctgatcgtcgtgagccaggcgtgccgaattcaggcgggtgcgcggaatgatgctggttcccaggtgggtcatgatgtcggtgaaatagcggttgcctgtagccagggcaatctgcaggtggaactggaaatccgaggccaccgcatcgctgtcgtgggccgcactctcattgagggcatccagcgccgcccgcatcgccgccagttgctcggtactgcgccgctgcgcggccagcccggccgactccacttccaggctgatgcgcagttccaggatcgccagcacatcgcgcaaggtcaccacggtcgccggatcgatcctgaagccgctcgggctcggtgtgtcgagcacaaaggtgccgatgccgtggcgggtttccacctggccggcggcctgcaagcgggaaatggcttcgcgtaccacggtccggctgacgccatgggcctccatgatcgccgactcggtgggcaacttgtcaccgcgcttgagctgaccgtcgcgaatctgctccgacagcacggtcaccagttcctgggcgaggctacggcgcttgcgtggaaggcggggcgccgtgttctggttgtccatggtgaagttctttctccgaaaactgatgacgcatcatagctcagccgggttgtacgatcactgttgactacaccgtcaccgcctggtcgaccagatgcccgcgctcgatacggatgtgccgcgggtggaaacgcttgaggctgctgcgatgcccgacgctgacaatgctcagccctggtagctggtcgatcagcgcctggtacagggttgcctcgtcttcttcgtccatggccgaggtggcctcatccatgtacagccactgcggcgcatagagcaacgcacgggcaaaggccaggcgctgctgctcgcccggggacagcatgcgctgccagtgattgctctcgtccaggcgagaaaccagatgcggcagtcggcaggtttccagcacctgcgcataacgctcctgcgggtaggtgtcgcccgactgtggataactcaaggcttcgcgcaggctgccgatcggcagataaggcttttgcggcaggaacaggtaacgctcggcgggcatgcgaatgctgccgtgaccggccggccagagccgccccatcgcccgcagcagggtacttttgccactgccggaacggccgctgagcatcaggcgctcaccgggattcacggtcatctcggcaccggccagcaggtgccggccgtccgccaggtccaggccaaggttatgcacctgcaggttttcaccctggctctgcacgtcgatggctggcgcgcgctcttcgttttcgctcatggcctggcggaagctcagcagccggtcgcaggtggcgcgccaggccgcgagctcggaataggcggtgatgaaccagctgaagttctcctggacgttgccgaatgccgagttgatctgcatcagctcgcccagctcgatcttgcccgtcaggtaacgcggggctgcgacgatgaatgggaaaatgattgcgatctggccatagcccgaggtgaagaaggtcaggcgcttggacactttcatgatgtcccagaagttgtgccagaccatgccgaagcgagcgctgaggcgtttgttctcattcggctcgccgtcgtacagggcaatgctctcggcgttctcccgcactcgcaccatggaaaaacgcaggtctgcctcgaaacgttgctggttgttgttcaagccgatcaggcgtcgaccgatcaggtgcgtcagccagctgccgacggcggcatacaccagggcgcaccagaacatgtagccgggaatggtatagccgaagacttcgatactgcccgacacgccccacaggatgatcgagaacgacaccaggctgaccacggtacgcagcaggcccagggcgagccccagggtattgctggtgaagctgttgaggtcttcggaaatccgctggtccgggttatcggtgtagccgccctgctccagctggtaatagttcttgtggcccagccagcgggcgaagtgtttttccgtgagccaggcccgccagcggatggtcagcatctgggtcaggtagagccggtagaccgcggccaggatggccaccgcggcaattccgcagaaatacaggatcagttgccagaacgccgcctcgtccttcttttgcagggcgttgtagaaatccttgtaccagctgttgatccacaccgagatcgccacgctgaacagggtcagggcgatcaccgcgaacagcagcaaccaggccttgcccttctcctcgctgcgccagtaaggcgtagtcatttcccagacacgacggaaaaactgcccgcgcacagcatcgttgaccgcggaatactcagcgttctgattcatcatcaaggctcgattgggatagggacaagcatcgagccgatcatagaggatcggctcgctttttcacttgtcctgaggacattcgttcagtcgcggttcagcggcgaaccgggcgcttctgcaacttgcgttgcagcgttcggcggtgcatgcccagggcgcgggcagtggcggagatgttgccttcgtgttcggtcagcacccgctggatgtgctcccattgcaggcggtccaccgacatcgggttttccggcaccagggtgtcgaggtcggcgtgctcggagagcagcgcggccagtacatcgtcggcatcggccggtttgcacaggtagttgcaggcgccgcgcttgatcgcttcgaccgcggtggcgatgctcgaataaccggtgaggatcaccacgcgcatctccggatcgagctcgagcagcttgggcagcagcaccaagccggagtcgccgtccatcttcaggtccagcgcggcgaagtccggcaggtcctgctgggcgagggccaggccttcctcggcggaacccgcggtgctgacgcgaaagccgcgacggctcatggcgcgcgccatcacccgggtgaaggtggcgtcgtcgtccaccagcaacagatgcggcagttcttcgccttcgacttggatttcgtcactcatgttggtctcctcgggcgccgtggggcaggcgcagctcggtgagcgtgccgccttcctcatgactgtagagtttcactgagccgccggcgcgtgtcacgctggctttgctcaaaaacaggcccaggccgaaacctttgcccttggtggtaaaaaacggtttgccgatctgctcggcgatggccagcggcacaccggcgccgtggtcacgaatgctgatggtcaggttctcggcatcccaatccagctggacttccagcccttccggacaagcatcggctgcattgttcagcaagttgagcaacgcctgggtcaggtccggcggcggcgccagccgcggcatcgtgcccttgcccagcagctggaagcggtagctggcttcggggcgcatcaggtgccagcggttcagcgcttcgtcgagccagacggtggcatcctgcatctccaccgccagccggcggttggcctcggcggcgcgcaccaactgttgcagggtttccttgcacagtttgacctggtcctggagcacgcccaggtcatcttgcagcattgggtcgaggtggtcctggcgcatttccttgagcagtacgctcatggtcgccaggggcgttcccagctcgtgggcggcgccagcggcctgggtcgcgacagccagcaactgctggtcgcgcaggccctcttcgcggcggatcgcccgcagctcctcctgccgccgcagctcttcggccattctcgcggcgaagaaggtgatcaccgccgcggccagggcgaagctcagccacatcccgtagatctgcaggttctcccgggcgatggggaaagtctgcagcgggtagaactgcgccagcagcaaggtgtacatggtcagcgcgataccggaaaggaccaccgaatagcgccatggcaaggtcacggcagcgatggtcagcggcaccaggtaataggagacgaagggattggtcgagccgccggagaaatacaacagggcgctgtggataaacaaatcacaagccagttgcacggcatattccagctcggtgaccggccacgaggtgcgcaggcgaatggcggtgaagacgcagagaatcagcgacaggcccagggtgatggccagttgcagccagggcagcggtagcaggtcgaaccagtaggcgagccccaccgaaccggcctgagcggccagaaccaggatgcggatgaaagtcagacgccagaggttctggcgagtggcggaaagcagttgtacgggggcgagcatgagctctcctgatgagcgctccaggcggatcgcgacgagtataaccaagcagcggcccagacaggcaaaactgcggcaaaccgccacagtcttgggcaatggccaatcgcgggcaagcctagcctgcaaaaacaccacctgcctgcaggagcgaagcttgcccgcgatagagcgcaaagcgctcgccatcccatctcagagtccggctcgagaacagattacgactgctgcgcagtcgggcgcaggcttcgccagcggctaccaaagccccccccgcagttggcgttgggtaatagatgtatagaagttgttaacgggccgaaccagacaataaaagctagagtctgatggtttcacgcaggctgggacccaatacctgcggaccgcactcaaggagttttcatgcatacattcagtcgcagcgccgcccttctcgccctcagcgccggcaccctcgccagcctgccggccctggccgccgatgagcttcattacaaccagatctccctgcgcgccgaagtcagtcaggaagtggcccgcgacctgatgatcgtcaccctctacagcgaatcgcagaacgccgacccggccaagctcgccgcggaaatcaccaccaccatgaacaaggccctgggccaggcacgccaggtcaaggacatcaccttgcgccagggcagccgcaacagctacccgatctacgacaccaagggccagaagatcaccggctggcgcgagcgcgccgaactgcgcctggaaagctcggacttcgccgcgctgtccaagctcaccggcgaactgctgaccgacctgaagatgggcgggatggattttgccatcgccgacccgacccgcaaggccagcgaagacaagctgctcaaggaagccgtcgatgccttcaaggctcgtgcgcagctgaccaccgaagcgctgggcggcaagggctacaagatcgtcaacctgaacctcaacagcaacggttatccacaaccgtatctgcgcggaccggtgatgatgaaagccgcgggcatggatgcggcgccggtcactccggaagtcgaggccggcaccagccaggtcagcatgaccgccgatggctcgatcgaagtcctgatgccgtaacgttttccctgctccccaacggcggtaacctgcagcacaacacaggttaccgcgcttttttgctacccactgtttcaacccgagcctgagggcctcgcctttttttgggtggaggggtgagctcggccacatcggtgatgttaaagttgcggcccccggtattgcgcctatcagacgtcactggcatccaccgggtatactgcgcctttcctataagagtctctccaatgaccgcagaccgcatcggcgaacgcctgcgtcgctatcgccgcgccgccaagaaaaccctgcgtcagatcgccagcgaatccggtctgaccgccagtttcctctcccaggcggaacgcaatctcaccggcgtctcgatctcctccctggtcaacattgccaagtctctgaacgttccgctgaacgccctattcgaccagccgacccaggcacaacccgactcccacgacggcaagcgggtgcgctacaccatcgaaggccagcccctgtcctacgagcggctgtccagttcctttcccggcaacctgatcaacgcggtgaagatgaacataccggtgggctaccagtcggaactgatctcccatgatggcgccgagttctcctacgttctttcggggcagattgtctacaccatcgaggggcagcagtaccccctcggcgccggcgactcggtgcacttcgactcgaccaaaccgcactacctggctaacgccggcaacggcccggcagaagtgttgaccgtcacgaccatgggcctgttcgacgaccattcagcggcctgaacccgccccgtggccgcctgcgcaacctcacagacaccccgtgcgcaagagaaatgttagtcacgcttaattttcgttgaccacgatttcagcatgacttaatttcggcatcggcgaatcgtcaatcaacccacaacaaagcgatcgccggcgccgcacagggtccatgggggtgcatccactccccatagaaggcgagttgccccggcccacaaggccactcctcagatacgccctagaaaaagaaaaaatgaggtttgcatgcgtaagacctttccgctccaggtttggcagacagcggggctgatcctcggcatcccactgtcgcacgccacccgcaacctccacagtgacaacttcactgcgagccacaacgtcaacgccgccgatgtgctgtgcacccgccatcgcctgcaaggtcccgggcatccgttctccacggcctccctcaccaagccgtcctacttcagccggtcaacccaatgcgccaaacacttgcgccaggcaggcaaggccaggcggctcaaccagaagccggtcgacacccgccccagcgacgcaccaagcggaggcacgactcgctccggatgccccgtaagaaggcaacccatgcaccagaaaaaaccagcgcatacggtcaaattcgtcaatatttatacaaatgcgtcattcctgtacgttcgttccactccttgatacttgtgatggccccgcatcttgcattgggtatggggcctgcataagtatcggcgggtcgactcataaggtcgccctctacaccaaaaatgacaacaaatcatgaggcaaccatgttcaaacaagcagtcattccgcttttagtcagcgccggcttgctcgccagcgcacccttcgcccaggcggcgactaacctggtgttctgctccgaagggagcccggccggtttcgatccaggccagtacaccaccggaaccgacttcgacgcctcagcagaaaccatcttcaaccgcctcagccagttcgagcgtggcggcaccgccgtcgttcctggcctggcgaccagttgggacattgccgacgatggcctgacctacaccttccatctgcgcgatggggtgaagttccacaccacgccgtatttcaagccgacccgtgatttcaacgccgacgacgtgctcttcacgttcaaccgcatgctcgacaaggacatgccgttccgcaaggcgtaccccactgaattcccttacttcaccgacatggggatggacaccaacatcaccaaggtcgagaaagtcgacgacaagaccgtcaagttcaccctgaaaaccgtagacgccgcgttcatccagaacctggcgatgagcttcgcctccatccagtccgccgagtacgccgaccagctgctcaaggaaggcaagccgggcgacatcaaccagaagccgatcggcactggcccgttcgtgttcaagagctaccagaaagactccaacatccgttacaccggcaacaaggagtactggaagcctgaggacgtgaagatcgacaacctgatcttcgccatcaccaccgacccgtcggtacgcatccagaagctgaaaaagaacgaatgccaggtcaccctgttcccgcgcccggccgacctcaaggccctgggcgaggacaagaccctcaagctgccgcagcaagccggcttcaacctcggctacatcgcctacaacgtgatgcctgtgctcaagggtcgcaccgacgccaacccgctggccgacctcaaggtccgccaggcgctggacatggcggtgaacaagcagcagatcatcgactcggtctaccagggcgcgggccagctggcggtcaacgccatgccaccgacccagtggtcctatgacgacaccatcaaggatgccaagtacgaccccgagaaagccaaggcgctgctcaaggaagccggcatcaaggaaggcacccagatcaccctgtgggccatgccggtgcagcgtccgtacaacccaaacgccaagctgatggctgaaatgctgcagtccgactgggcgaagatcggcctgaaggtcaacatcgtcagctacgaatggggcgagtacatcaagcgttccaagggcggcgagaaccaggcgatgatcatcggctggagcggcgacaatggtgacccggacaactggctcggcaccctgttcggctgcgacgccatgaacggcaacaacttctccaaatggtgcgacaagccgtacgacgcactgatcaagcaagccaaggccaccccggacgtggccaaacgcaccgagctgtacaagcaggcgcaacacctcctcaaagaccaggtcccgatgacacctatcgctcactcgacggtgttccaacccatgcgcaccaacgtgcaggacttcaagatcagcccctttggcctgaactcgttctacggcgtcagcatcagcaaataagggtctgcaacggcgacgtcacctgatgtcgccgttgccttacctgccaggactgccggaacttcgaacgctcttcctcttgctgcgccccatcgtggtgagtacgggcatttcggaagttccttacatgtctttcaggctctttggcatttactacccatgcggcgacccctaccgtcaaagcatggagtggtgcatccattgcccggcatttgctgcaagcgagacttgggatcaatgacatgaccgcctccggatggggcgactgctcatcgatcaaaacaataaaaagggagaggggatcgtcatgcgtcattctctggttttatccgccctgctgggcaccggtctgttgaccgcaacctccgccagcctggcggccggcaacagcctggtgttctgctccgaaggcagcccggccggtttcgacaccgcgcaatacaccaccgccaccgacaacgacgcggcagagccgctgtacaaccgtctggcggagttcgaaaaaggcgcaaccaatgtggtgccgggcctggccacccgctgggatatttccgcggacggcctgcagtacaccttccatctgcgcgagggggtgaagttccataccacgccgtacttcaagccgacgcgtgatttcaacgccgacgacgtggtcttcaccttcacccgcatgctcgaccccgagcaccctttccgtaaggcctacccgaccgagtttccctacttcaacgggatgagcctgaacaagaacatcgccaaggtcgagaagaccgggccgctgaccgtggtgatgaccctgaactcggtggacgccgcgttcatccagaacatcgccatgagcttcgccgcgattctctcggccgaatacgccaaccatctgctcacggccggcaagcccagcgagatcaaccagaagccgatcggcaccgggccgttcgtgttcaagagctaccagaaagactcgaacatccgctacaccgccaacaagcagtactgggacccgagccgggtcaagctcgaccagctgattttcgccatcaacaccgatgcctcggtgcgcgtgcagaaactcaaggccggcgaatgccaggtcaccctgcacccgcggcccgccgatgtcgaagcgctgaaaaaagacccgaaactgcaactgatcgaaaagcccggcttcaacctcggctacatcgcctacaacgttcgccacaagcccttcgaccagctcgaagtgcgccaggcgctggacatggcggtgaacaagcagggcatcctcaacgccgtgtaccagggcgccggccagctggcggtcaatgccatgccgccgacccagtggtcctacgacaccagcatcaaggacgccgcctacaacccgcaaaaggcccgtgagctgctcaaggccgccggggtcaaggaaggcacggaaatcaccctctgggccatgcccgtgcagcgcccctacaaccccaacgccaagctgatggccgaaatgctccagtccgactggggcaagatcggcctgaaagtgaagatcgtcagctacgaatggggcgagtacatcaagcgcaccaagaacggcgagcacgacatcagcctgatcggctggaccggcgacaacggtgacccggacaactggctcggcaccctgtacagctgcgacgccattggcggcaacaactactccatgtggtgcgacccgcagtacgacaagctgatcaagcaggccaagatcgtcaccgatcgcgaacagcgcacggcgctctaccaacaggcccagcagttgctcaagcagcaggtaccgatcaccccggtcgcccactcgacggtcaaccagccgttaagcgccaaagtcgaaggattcaaggtcagccccttcggccgcaacgtgttctcgggcgtcagcatcgaccaataaatgattagccaggccgctgggggcgatcttcgcccccacgcaaatctgttgcctgaattcggtgatcccacctcatgcaaacgtttgcgatgccttgaatgagttgtaaagcaaaagccggtcaacccaaaaagaccggcataaaaataaagaaagcaaaggagcttcacccatgaaaccgagcaaaaccgcgttactggccctggccatcagcagcatcacggccatggcccatgcggaaagcgtgagtcaggaattcgttccgaccgaactgaacggcaccagcgcccaggcggaggccaagggcttcgtcgaaggccagagcctgtcgggcacgacccgcaactggtacgccaacgagctgaagcgtcgtgacgaccgcttctcctacaaccacaacggccagccgacttcgaccccacgccggatcaactgggtccagggcaccatcctcaactacagctcgggctttaccgaaggtactgtcggggtcagcaccgaggtggccgcctacaacgccatcgcgctggatcgtgaccgcaaggacatcgccggcaagaacaaccgtaccctgacccactccgacggcgacgctgtcggccagtggagcaaactgggcctggccaacgtcaagttccgcgtctccaacaccaccctgaccgccggtcgccagaacttcagcacgccgatcgtcgacgtcatcggcaaccgtgccctgccttcgagtttcgaaggtgtgagcctgcacagcgaagagttcaacaacctgtcgttcgatctggccggtttcgatcgcgtttcgccgcgtaccgaacagagcctgtcgaaattccgcaccgagtattccgccactggcgtggaaaccgacaaggtctacaccgcaggtgtgaactaccagccgttcaagagcctaaaaaccagcctgtatggtgccaacgtcaaagacttctggaaccagtactacttcggcgccacccacgagctgggtgacagccaggtattgagcctgaccaccggcctgaactactacaagaccgtcgacgaaggtaagaagttgatgggcgagatcgacaacgacacctactcgctgtcgctcggcctggctcaccaggcccacagcctgaccttctcctaccagcaagtgaacggtaacgagtacttcgactacctgcatgaaaccaacggtatctacctggccaactccctgctctcggacttcaacggcccgaacgagaagtccttccagatcgcctacggtctgaacatggccgaatacggcgtgccaggcctgaagttcaacatctactcggcacgcggctggggcatcgacggtacccactaccgcggcaccgcctacaccgacccaggcgcccagcgcggcgacctgagcctgatggatggcgaaacccactacgaatacggtattggcgcgtcttatgcagttcagagtggtccgctcaaggccaccgccattcgtgcgacctacaccacgcaccgggccagcgaaaaccaggccgacggcaacatcaacgagttccgcctggttaccaccatcccgttcaagattctctaaaaacacatcggctggttggcgaattcatgacgaattcgccattccagctactctggttcaaccgattgcagagggttctagatgaaaatgcttcccctgaaagcggccatcgccgccgcactgctgagcgtcgccgcaggcgtctcggccaagcccttggtggtctgtaccgaagccagcccggaaggcttcgatatggtccagtacacgactgcagtcactgccgacgcggtggcggaaaccatcttcaaccgcctggtggacttcaagcccggcaccacggacatcgagccggccctggccgagtcctgggagatcagcccggacggcctgacctacaccttccacctgcgcaaaggcgtcaagttccacagcaccgattacttcaagccgacccgcgagatgaacgccgacgacgtgctctggagcttccagcgtcagctggacccgaaacacccgtggcatgacaagtccagcgtgggcttcccctatttcgagagcatgggcttcaaggaactgctcaaaagcgtcgagaaaaccgacgaccataccgtggtcttcaccctgacccggcgcgaagcaccgttcctggccgacgtggccatggccttcgcctcgatcttcccggccgaatacgccgaccagctgctcaaggccggcaagcccggcgaactgaacagcaagccgatcggcaccggcccgttcatcttccagcgctacgccaaggacgcccaggtgcggttcaaggccaacccggactacttccgtggcaagccgccggccaacgcgctgatcctggcgatcaccaccgataacaacgtgcgcctgcagaagctcaaggccaacgagtgtcaggtcgccctgtatccgaagccggacgacatcccgagcatcaaggccgacgccaacctgaaggtcgacgacctggccgccatgaccgtgggctacgtggccctgaacaccaccaaaaagtacatgagcgacccgcgtgtccgtcaggccatcaacatcgccttcgacaaggaagcctacgtcaacagcctgtacggcaagggcaacgcggtggtcggcaccggcccctacccgccgaccctgctgggcttcaacaccagcctgggcaacccggcccgcgacctggacaaggcccgcgccctgatcaaggaagccggcgtgccggaaggcacggtcttcaccctgttcacccgcaacggcggtggcccgaccaaccccaacccgctgctcggcgcgcagatgatgcagtccgacctggcgaagatcggcctcaagatcgacatccgcgtcatggaatggggcgagatgctcaagcgcgccaagaacggcgagcacgacatggtttccgccggctgggcgggggataacggggacccggacaacttcctgacccccaacctcagttgcgaggccgccaaaaacggcgaaaactacgctcgctggtgcaataaagcgttccagagcctgatcgatcaggcccgcgccgaatccgagccggccaaacggaccgcactctatgaacaggcccaggacattttcgacaaggaacaaccctggatccccatggcctatccgaaaatgttcacggcaatgcgcaagaacgtcgagggctaccaccagagccccctgaccaccaacaacttcgctaccacccaggtgaagtagataagaaacgcccggcatccctgaccccaggggtgccggacacgcctaaccggctgatgaggtacaccagaagatgtttagttttattgcccgccgtgtggggttgttgattcccacattcttcggcatcaccttgctgacgttcgcattgattcgcatgattcccggcgatcccgtggaagtcatgatgggcgagcgccgggtcgaccctgagatgcatgcccaggcaatggaacgccttggtctgaacaaaccgctgtatgcccagtacctggactacatcggcaaactcgcccagggcgacctgggtgaatccctgcggactcgcgagagtgtgtggagcgagttcacctccctgttccccgcaaccctggaactggcctcggccgcgatgctgttcgctgccgtgatcggcctgctggccggggtgatcgccgcgctgaaacgaggatccctgttcgaccacggggtgatgggcatctccctcgccggctattcgatgccgatcttctggtggggcctgatcctgatcatgttcttctccgtgagcctgggctggaccccggtttccgggcggctcgacctgctctacgacatcgagccgaaaaccggcttcatgctcatcgacaccctgctggccgatgacaccggcgccttcttcgacgccctgcaccacctgatcctgccggccatcgtgctcggcaccattccgctggcggtgatcgcgcggatgacccgttcctcgatgctcgaagtgctgcgcgaagactacatccgcaccgccaaggccaagggcctgtcgccggcgcgcgtggtgttcgtgcacggcctgcgcaacgcgctgatcccggtgctgaccgtggtcggcctgcaagtcggcaccctgctggccggcgcggtcctgaccgaaaccatcttctcctggcccggcatcggcaaatggctgatcgaagccatcggcgcccgggactaccccgtggtgcagaacggcatcctgttgatcgcctgcctggtgatcctggtcaacttcgtggtggacatcctctacggctttgccaacccacgcattcgtcaccagcgctgaggacaatactcatgagcactccaacctcctcagtagccgtatccgccgtggccgtggatcaaagcctgctgtacccgtcgccgtacaaggaattctggcaggccttctcgcgcaacaagggcgcggtggccggcctgctgttcatgctgctggtgattttctgcgcgatcttcgcgccctgggtcgccccgcataacccgagcgagcaataccgcgacttcctgctgaccccgccggtctggctcgaaggcggccaatggcagttcatcctcggcaccgacgaactgggccgcgacctgctgtcgcgcctgatcaccggttcgcgcctgtcgctgctgatcggcctgtcgtcggtggtcatgtcactgatcccgggcatcctcctgggcctgttcgccggcttcttcccgcgcctgctcggcccgaccatcatgcgtctgatggacatcatgctggccctgccgtccctgctgctggccgtggcgatcgtcgccatcctcggcccaggcctgatcaacaccgtgatcgccatcgccgtggtgtccctgccgtcctacgtgcgcctgacccgcgccgcggtgatgggcgagctcaaccgcgactacgtgaccgccgcgcgcctggccggtgccggcctgccgcgcctgatgttcatcaccgtgctgcccaactgcatggcgccgctgatcgtccaggcgaccctgagcttctcctcggcgattctcgatgccgcggccctgggcttcctcggccttggcgtccagccgcccaccccggagtggggcaccatgctggcctcggcccgcgactacatcgaacgcgcctggtgggtggtgagcctgcccggcctgaccattttgctcagcgtgctggcaatcaacctgatgggcgacggcctgcgcgatgcgctggacccgaaactcaagaacgccgcctgaggagattcccatgtcactgctagaaatcaagaatctcaacgtgcgcttcggcgacgcccaggccgttcccgtggtggacggcctggacctgaacgtggacaaaggcgaagtcctggccatcgtcggcgaatccggctccggcaagtccgtgaccatgatggcgctgatggggctgatcgagcatcctggcatcgtcaccgccgacgccctcagcttcgacggcaaggacatgctcaagctcagcgcccggcaacgccggcagatcgtcggcaaggacctggccatggtgttccaggacccgatgaccgcgctgaacccgagctacaccgtgggcttccagatcgaggaagtgctgcgcctgcacctgaagatgtccggcaaggcggcccgcaagcgcgccatcgaactgctggaaaaagtcgagatcccgggcgccgccagccgcatggacgcctacccgcaccaactgtccggcggcatgagccagcgcgtggcgattgccatggcgattgccggcgagccgaagctgctgatcgccgacgaaccgaccaccgccctggacgtgaccatccaggcgcagatcatggagctgctgctcaacctgcaacgcgagcagaacatgggcctggtgctgatcacccacgacctggccgtggtcgccgagaccgcccagcgcgtgtgcgtgatgtacgccgggcaagcggtggaagtgggccaggtgccggagttgttcgacatccccgcccatccctataccgaagcgctgctggcagcgattcccgagcacagcatgggcgccgcgcgcctgtcgacgttgccgggcatcgttcccgggcgctacgaccgtccgcaaggctgcctgctctcgccgcgctgcccgtacgtgcaggaaaactgccgccagcagcgtccaggcctcgacccgaaagccgccagcctcgcccgctgcttctacccgctgaatcaggaggtggcgtaatggccgtcgttcttaccgcccgcaacctgacccgccactacgaagtgtcccgcggcctgttcaagggcaatgcgaccgtgcgcgccctcaacggcgtgtcgttcgagctggaagccggcaagaccctcgccgtggtcggcgagtccggctgcggcaaatccaccctggcccgggccctgaccctgatcgaagaaccgtcctccggctccttgaaaatcgccggccaggaagtcgccggcgccgacaaggcccaacgcaagcaactacgcaaagacgtgcagatggtgttccagagcccctacgcctcgctcaacccacggcagaagatcggcgatcaactggccgagccgctgctgatcaacacccagctgtcggccagcgagcgacgggaaaaggtccaggcgatgatgaagcaggtgggcctgcgccccgagcattatcagcgctacccgcacatgttctccggcggccagcgccagcgtatcgccctggcgcgggcgatgatgctgcaaccgaaagtgctggtggcggacgaaccgacctcggccctcgatgtgtcgatccaggcccaggtgctgaacctgttcatggacctgcagcaggagttcaacaccgcctatgtgttcatctcccacaacctggcggtggtgcgtcacgtcgccgaccatgtgatggtgatgtacctcggccggccggtggaaatgggcccgaaagaggacatctacacccgtccgctgcacccctacacccaggcgttgttgtcggccacgccgaccattcacccggacccggacaagccgaagataaagatcgtcggcgaattgcccaacccgctgaacccgccatccggctgtgcgttccacaagcgctgcccatacgccaccgagcgttgcagcagcgaagagccggccctgcgcctgctcgacacccgccaggtggcctgccactacgccgaacagttcctcggctgagccggcaaaaaaaggcgccgcggtgacccgcggcgcctcatctgtgttgaccaaaccccttctgccggattgcgcatcagtccggcaggaggggtttctttttccgccagcctggctcagccctggctagcctcgtcatcgctgtcgggatccggctcgtcggtggtcgaatcgtcatcgccctcgctaccaccctgtccctggtcgcccggctcggattccgacttggcgatcatctgcaccccgctctgcaaatgccccggcccccagaaacccggcacccgcgccgcctggtcgccggcccaggccgcggacatgcccagcgacaacagcaccagcaccttgagcaacagcacaactcgttggaaaacattcatgttgattccatccctttatgtaggtgaatcaatgggcccacaggccctgacctgcaaggcgcggcttcgtatgaaacctagccccctgaaacctagccccgaagccggcgcttttccagatagcaagctagctatccgcctactggatagacggctttcgactaggccttaaaacctgcggttatgccccgcgtccgtaggaactgccggtcgaggctcgattgctcgcgatgggctgcacagcagccccaaaacctgccaccgcgttctgtctggaaacaatcattgcccgaaccggtgttttcgcgggcaagcctcgctcctacgagggatagcgcaagccagggcctacatacagagcccccctgtacgcaggcatatcagattcatcttattcatcgagatgcccggaatcgatagcattccttcccccgactgaaacttatccacaacaccatcgaaccctatcgtcgggcagaacatgcagcgcagtggatgacgcgaacctgcttctcaacgagcggcagggaaatccctcccccgctcactttcgctcccagacaggtcccccatgctcttcaagaaaatgctgtcgacattgattctggttaccacgctagccgggtcccattcggctttcgcatgttactggtggctaggcaatacgccccagcaaaacatcaccatacctgccttgaggggcactactaccctgacccctgcggcgattggcaacatcatggcatcgcagaaaatcagcattgccagttcggcgccgacgttagtctgtaacggcgagagctatggaatgaccctgaatatcacggggatggagccttccggattgcccaatgtatacaaaacggatgttgcaggcgtcggagtcagaatcggttttgacggcgactcatcctggggaggtatccaataccccccatttgagcggtccaacaccaatacgtccatgctcatcagtgtgctcattgaatacgtccgcacgggcaccgccgtcggtaaagggccaatctcgttcagctttaactccgaattaaaagctcccggtatcagccctatccgtattaccggtacggacctgaagaccaacgtgaccaacagcgtttacttcagcgcctgcgaagcacaagtcaagagcctcatcgtccccatggggaaagtcgcctccgccaatatccgcaacggcaacacccaggcgcagaacttcaatttgaacgtgtactgcaagggcctgcgccccacccagccggcgccggtcaagatctatttcgaaggcgccaccaccagcgatggcctgctcaagttcaacaatgccgggcaaagccatgtcgccagcggcgcggccatcgaactcaccaacggcaagggcacccggcttcccttcaccccgagcaaggccctcaacctcgactggcagcacagccaacccgacgccgaggtctaccattttgctggccaggcccgttacgtcccgagcggtggcgaggtgaaagccggtaaagccgatgcagtggtcagttatgtgctggtgtacaactgagcctgatcctgcctttacgtgcataaaaaaaggttcttcacggaatcccgggaaacacagaaacaagaacgccgatttgattgatgatgttcgtgcgagcaaacacatctaacaaaccggcgttcttatgcgtgatattaatactttccttcccttttgggagggcttttctgtcgtcacgatcaagcctgatggtgacgcgctccagatcgatctgattccccacgccacccgattcccttcctgtggcggctgccaaaaactctgttcaaccacgcatgagtactgccagcgagtcatccgcgatctgcccattcttggccgagcagtgcgcctcagcgttttgcttcggcgtgtcggctgtcgggactgtggcaaacgcatggaggccgtcagttggctggatcgctatgcccgcatgacgcgccgcctggccgatgcggtcattcaggcctgcgagcgccttcccacgctacacgtggcccaactgttcgggttgcattgggacagcgttcgcttgctggaacgtcgcgccttgcaagcggcattgagtgttttgccaaaggcgcagccacagcgcttggtcatggacgaatttgccctgttcaaaggtcatcgttacgccagcgtagtgctggacgccgatacccggcgagtgctgtggattggcgaaggccgcagccgggcggcagtcagaccctttttcgaagagctggggtcagagggttgcgctcgcatcgaagcggtggcgatggacatgaacactgcctttgacctggaggttcgtcagcactgcccaaaagcgcgcgtggtctacgacctcttccatgtggtggccaagtatggtcgagaggtgattgatcgagtccgcgtcgatgaagcgaatcggctacgtcacgacaagcctgcccgcacggtcatcaagcaggcgcgatggctgttgctgcgcaatcggcagaacctgaaaacgccggaacaacaagtccgcctggaggatctgctggcggccaaccaagcgttgatgacggtctatttgatgaaggctgaactcaaaacgctttggacaccgagcaccgcctggggctggcgatcagcctggcgacaatggctgcgccatgcgcatgaaagcgacataccgcctctgatccagtttgccaaacgactgaagggttactggcggggcatcgtcagccgggtgcgctggccaatgcatacgggccagttggaaggcatcaacaatcgaatcaaggtcatcaagcggatggcgtacggttaccgggacagcgaattctttttcatgaagatcaagagcgtctttcccggtaatccgtgaagaacctaaaaaaagccccgctgtttggcagcggggcttttttatgcactggagcgtcgctcagaccttagtgatgctcgcgggtcgcgcggaatttcacgtcgggccagcgctcttccatcagcgccaggttgacccgggtcggggccaggtaggtcaggtgaccgccaccgtccagtgccaggttttccacggccttgttggagaattcctcgagttttttcttgtcgctgcaatcgatccagcgcgcggaccacacggtgatcggctcgtaggagcactcgaccttgtattcctctttcaggcggctggcgaccacatcgaactgcagcacaccgacggcgccgaggatgatgtcgttgctgcgctcggggaagaacacctgggtcgcgccttcttcggccagctgttgcaggccctggcgcagttgcttggatttcagcgggtccttcagacgcacgcggcggaacagctccggggcgaagtgcgggataccggtgaagcccagggcctcgccttcggtgaaggtgtcgccgatctggatggtgccgtggttgtgcaagccgatgatgtcgccggcgtaggcttcttcgagctgttcacgctcggaggagaagaaggtcagcgcatcgccgatgcgcacgtccttgccggtgcgcacgtggcgcattttcatgcctttctcgtacttgcccgagcagatgcgcatgaaggcgatccggtcgcggtgcttggggtccatgttcgcctggatcttgaacacaaagcccgtgaacttttcttcctgcggctccacggtccgctcgttggccacgcgcgccagcggcagcggtgcccagtcgacaaccgcgtcgagcacgtggtcgaccccgaagttgcccagggcggtaccgaaaaacaccggggtcagctggccgtccatgaacgcctgctggtcgaactcatggcaggcgccctgcaccagctccaactgctcgatgaagcgctcgtactcgtcgcccaggtgggcgcgggcttcatcggaatcgagcttctcgatgatcttggtttcggtgcgctcgtggccgtggccaggggtgtagacgatgatgtagtcgcccgccaggtggtacacacccttgaagtcgcggtagcaaccgatcggccaggtgatgggcgccgccttgatcttcaggaccgcttcgatttcgtcgagcagttcgatcgggtcgcggatatcacggtcgagtttgttgatgaagctgacgatcggcgtatcgcgcagacggcagacgtccatcagggcgatggtccgaggctctacgcccttaccgccgtcgagcaccatcagcgccgagtccaccgcggtcagggtgcggtaggtgtcttccgagaagtcttcgtggcccggggtgtcgagcaggttgatcatgtgttcgcgataagggaactgcatgaccgacgtggtaatggaaatacctcgctgcttctccatctccatccagtcggaggtggcgtggcggtcggacttgcgggacttcaccgtaccggcaactgcaatcgccttgcccatcagcaagagcttctcggtgatggtggttttacccgcatccgggtgggaaataatggcgaaagtgcggcgtttcgcgacttcggcggcctgtttggtcatgggaaatcgcctggcaggtgattcaaaaaaagggcggcgagtatagcgcaaagcaagctccacggaccaccgttcggccctcgcccctgcaacccttgccctgtagcccttgccctgtagccgctgccgagcagcgcgaggctgcgatcaggctgggcggcatgcgatgttgctctgtcaggtatgccgaggaggctggttctgcgacagctgcgccgccgatcgcagcctcgctgcgctcggcagcggctacagatgccaggcatcagagatatcggagttatgggattgagggtggccaaacgctgccaaatatggaaccttttaaaaggtggaggcgtccactcccctgttacgagctttcgtcaggggtagaaaaatcagcaagttagcctgacgaggctatgcgtatggctcgatcccgcgctgtttccagcgcagcgacgagctgcttctcgcgaccgttcttttggcagccaggtatggccttgccacacgaaagaatgctcgccgacatgaaaaaggagtccgcctgtggctattcgctatggcaaagggctgataggaggcgcggcggtcatcgctctcctggccctgctggtccactggatcggcatcagtacgatcgaacactaccgcgacgatctgttgttttacctgcaagcccatctgtacctggtactcgcttcaatgttcgccgccctcgtggtggggatacccgccggcatcttcctcagccgaccgcagatggtcgggcgtgccgagcgtttcatgcaggtgttcaacatcggtaacaccgtccctcccctggccgtcctggccatcgctctggggatcctcggcatcggcagcgggccggccatcttcgccttgttcctcgcctccttgctgcccatcgtgcgcaacacctacgaaggcctgaaaaacatccagggttccctcaaggaagccgccgtcggcatcggcatgacgccgcgccaggtgctgtggaaagtcgagctgcccaacgccgtgccgatcatcatcggtggcgtgcgcgtggccctggcgatcaacgtcggtaccgcgccgctggccttcctgatcggcgccaacagccttggcagcctgatcttccccggcatcgccctgaacaatcagccgcaactgctgctcggcgcggcctgcaccgccttgctggcgctgctgctcgacggcctggtgacactggccagccgcctctggctggaacgcggcctgcgcccgtcttaagcctgcgcgaaggaattcacatgaaaaaaatagctttgatcataggctgcgtcctgctgtgcgcgggaattgcccaggccgcgcaaaagccggtgatccgcatcggcgcccgggtcttcaccgagcagacactgctggcggaaatcacctcgcagtatctgcgcagcaagggctacgacacccaggtcaccggcggcctgggcagcaacctggcacgcagcgctcacgaaagcgggcagctggacatgctctgggaatacaccggggtgtccctggtggcctacaaccacgtgacggaaaaactcgacagccaacagtcctatgagcgggtcaaggagctcgacgggaaaaaaggcctggtctggctgaccccgtcgaaattcagcaatacctacgccctggccttgccgaaaaacgtcgcggacgcatacccgcagatcaacagcgtcagcgacctgaaacacgtcctcgacgccgaacgccaggaccaccacctgatcgccctggacaccgagttcgccaaccgctccgacggcctgcaaggcatggtcaagctgtacggcatggacctgacccgcaagaacatccggcagatggacgccgggctggtctacaccgccctgcgcaacggccaggtgttcgccggcctggtctacaccaccgacggccggctcaacgccttcaacctgaaattgctcaacgacgacctgcattatttccccgactacaccgcggcccccgtggtgcgccaggcctacctcgacgcccacccgcaactggccgccgacctcaagccgctggccgaactgttcgacgacgaaaccatgcgccagctcaacgcccgggtcgacgtcgaccatgaaagcccatccgccgttgccgcagatttcctgcgccagcatccactgaattgagggaggaaagagccatggaatttctcaacgccttttcccatctcgactggcagcaagtcatccagctgacctggcagcacatcaccctggtgggcatcgccgtgaccctggcgatcctcttcggcgtgcccctgggcatcctgatgacccgcttcccgagcctggccgggccgctgcaagccagcgccaccgtgctgctgaccatcccgtcgatcgccctgttcggcctgctgctgccgttctactccaaattcggtcagggcctggggccgctgccggcgatcaccgcggtgtttctctactccctgctgccgatcatgcgtaacacctacctggcgctgaccggcgtcgagccggggattcgcgaagcggcccgcggcatcggcatgaccttcggccagcgcctgcgcatggtcgagttgccgatcgccgtgccggtgatcctcgccggcgtgcgtaccgcggtggtgatgaacatcggtgtcatgaccatcgccgccaccatcggcgccggcggcctgggtgtgctcattcttgcttccatcagccgcagcgacatgtcgatgctgatcgtcggcgcggtgctggtcagcctcctggccatcttcgccgacctgcttctgcaatggctgcaacgttcgctgactccaaaaggactgctcaaatgatcgaacttcaaaacctgaccaagaccttccaaagcaacggcaagaccatcaccgccgttgactccgtaagcctgaccgtcaatgaaggcgaaatctgcgtgttcctcgggccatcgggttgcggcaaaagcaccacgctgaaaatgatcaaccgcctgatcaaaccgacctcaggcaagatcctgatcaatggcgaagacaccaccgatctggacgaagtgaccctgcgccgcaacatcggctacgtgatccagcagatcggcctgtttcccaacatgaccatcgaggaaaacattgtggtggtgcccaagctgctgggttgggacaagcagaaatgccatgaccgcgcccgcgagctgatgagcatgatcaagctggaacccaagcaatatctgcatcgctacccacgggaactgtccggcggccagcaacagcggatcggcgtgatccgcgcgctggcggccgatgcgccgttgctgctgatggacgaacctttcggcgcggtcgacccgatcaaccgcgagatgatccagaacgagttcttcgaaatgcagcgggcgctgaacaagaccgtgatcatggtcagccacgacatcgacgaggccatcaagctcggcgacaagatcgccatcttccgcgccggcaagctgctgcagatcgaccatccggacaccctgctggcccatccggcggacgagttcgtcagcaacttcgtcggccaggacagcaccctcaagcgcctgctgctggtgaaggccgaggacgccgccgacaacgcgccgtcggtgagcccggaaacgccggtggccgacgccctggaactgatggacgaacacgaccgccgctacctggtggtgacctgcgccgacaacaaggccctggggtatgtgcgccgccgcgacctgcaccgccaggccggcacctgcgcccagtacctgcgcgaattcaacgccaccgcggcctacgacgaacacctgcgcatcctgctgtcgcggatgtacgagttcaaccgttcgtggctgccggtgctggatgccgagcgggtgttcctcggcgaagtgacccaggaatcgattgccgcctacctcagctccggccgctcgcgcggcatgaaaaccaacatcgtctcgccggccgagactgcgctggcctgacctgccgcatcggcccgatcttgtagccgctgccgaagaatgaggctgcgatcggccgcaaagcggccgtgcccccctgccctcggtgccctgatataccgaggtgccgggtctgcgtctgcttcgcagtcgatcgcagcctcgtgcctcggcagcggctacagtgcctcgcgacaccagcccgcactgggcccctcacgccacggattccctaccctggggaacatcagcctgtcatctgggtcggttacataaatgactggctcgggccacgcgacgaacgcgtgcaaaaacgcgacattttttgttgatctcaggcccctcacgccctaaagttcgcgccgaacgtccatgctggaaacgatccatccggctcaagtactgacgacgagacagcaaggccatagggaaaccttttgcagatcgtttgagagcgtagcgagcgcaggcaagacaaggcgggaagaggcgaggaagcggagtttactggttgtaaatgagcatttccgagcctcttcccaacgcagtattgctcgcgtagcgccgaaggcgcacagcacgcagtagctctcaaacgatctgggtggcctttttgctttcggcggcaatgccttgggaagtaggcgaaccaaagtggggatacggaggacgttcatttgcacccattgtttttacccgtttgccattaggagctcccaggtatgtcgattcaggtcgaagactatttcgcgcgcgaaacctttcagaaaatgaaggcattcgccgacaagcaagaaaccccgttcgtggtcatcgacacccagatgatcgcccaggcctacgatgacctgcgtgccggtttcgagttcgccaaggtctactacgcggtaaaggccaacccggccgtcgaaatcatcgacctgctgcgggaaaaaggttcgaacttcgacatcgcctcgatctacgagctggacaaggtgctgggccgcggcgtcagcccggaccagatcagctacggcaacaccatcaagaaatccaaggacatccgctacttctacgagaagggcgtgcgtctgtatgccaccgactccgaagccgacctgcgcaacatcgccaaggccgcgccgggctcgaaagtctatgtgcgcatcctcaccgaaggctcgaccaccgctgactggccgctgtcgcgcaagttcggctgccagaccgacatggccatggacttgctgattctggctcgcgacctgggcctggtgccttacggcgtgtcgttccacgtgggttcgcaacagcgcgacatcagcgtctgggacgcggcgatcgccaaggtcaaggtgatcttcgaacgcctgaaggaagaagacggcatccacctcaagctgatcaacatgggtggcggcttcccggccaactacatcacccgcaccaacagcctggaaacctacgccgaggaaatcatccgcttcctcaaggaagacttcggcgacgagctgccggaaatcatcctcgagccaggccgctcgctgatcgccaacgccggcatcctggtcagcgaagtggtgctggtggcgcgtaaatcccgtaccgccgtggaacgctggatctacaccgacgtgggcaagttctccggcctgatcgaaaccatggacgaagccatcaagttcccgatctggaccgagaagaaaggcgagacggaagaagtggtgatcgccggtccgacctgcgacagcgccgacatcatgtacgagaactacaagtacggcctgccgctgaacctggccatcggcgaccgcctgtactggctgtccaccggggcctacaccaccagctacagcgctgtggaattcaacggcttcccgccactgaaatccttctacctgtaagcgccacgccgtaacgaaaaagcccatgactggtcatgggcttttttatgcctgcgcgataaacgctgaaaaaatgcttctgtaggagcgaagcttgctcgcgataggccgaaggccggggtggccttgatgccgccttcgcgggcaagcctcgctcctacagaagctacagctgggctaatgcctcgcgatcggtttcattccctaactgcgccgcacgctggtgataggccagggccaggccacgaatctctggatgggccgcctgcaacaaggcgcggcgggcgacccgcaagaagttcaagttaccgccttccagggccttgtttagccaagccagcgcctcgtcgatacgcccggcatcggccagcaccgcggcatggctgaactgcccacggaaatccccgccttcggcggaacggcgataccagtcacaagccgccgcgacatccctggggcagtggcgcccctcctccagataacggcccaacaggttcatggatttggcgtggcccatcgccgccgcgcgccgatagcagctcaaggccagggcctggttttcagcgaccccgcgaccggtggccagcaggttggcgtagttgtacagcgcccagtccagcccggcttcggcggcctggcgataatgcccggcggcggcctgggcatcggcctcgcagccccagccatgctcgtggcaacgccccagcatgttgcgcgccatcagctgcccgcccttggcggcgatcgcgaaccagcgcagcgccagcgcctggtcacgctcgatgcccaggccgtcgagcaggatctgcccgagcagcgcctgggcatccggcacgccctccccggctgccagcaggatcgcctgggcggcccgggccgggctctgttcgagcatggcgcgcagttgctcgccgtcgaggacttcctcgcggcgcaactggaaactcacggcttacacctcgacccagcgacgcaacaggttgtggtaggtgccggtcaggcggatcagcgacggatgctccggcatatcgcgggtcagttgctggatcgcctcgtccatctcgaacagcagggcgcgctggctgtcttcgcgcaccaggctctgggtccagaagaacgacgcataacgggtgccgcgggtgaccgcgttgaccttgtgcaggctggtgcccgggtacagcaccatgtcgccggccggcagcttcacccgctgggtgccgaaggtgtcctggatttccagctcgccgccgtcgtagtcctccgggtcgctgaaaaacagggtcgacgacaggtcggtccgcacccgctcgacgctgcccttgggctggcgcacggcgttgtcgatatgaaagtcgaaactgccaccggcggtgtagcagttgagcagcggcgggaaaaccttgtgcggcagcgccgccgacatgaagcgcgggtgctgccacaggcgctcgagcatcgccgcgccgatctcctgggccagcgggtgaccttcgggcagctgcaggttgtgcttggccttggccgactggtaaccggcggtgatcttgccgtcggcccagtccgcctgctccagggcctcacggatacgcagcacttcttcacgggagaacaggccgggaatatgcaggagcatgaggcaatacctgaaagcaaagggggtgcaaatgatattgattcttattgaaaatgtaaaatgcgtagacgaatgaaagcgtaaaaaccgtaaagcgaaattgtaaagaatgtaaattccacgcgaatagcaatatttcgcaattgatacatagacttgttcgccttatattccgccgcctcaaatccttggggaggggaatcaccatgtcgcgccaaccaccacaattaccgctcggttcaccacgcctgctggcgtctgcgattggcgtggcgatcaccgccggctccgcagcccatatggcttatgccgcggaaaacaccgagaagaaagccgccggcaatgccatttccctggacgccaccagcatcaccggcgaagcccaggaccagacgtcctaccaggtcgaaaaagcctcgtcgcaaaagtacaccgcaccgctggtcaacacgccgcgctcggtcaccgtggtgcctcaacaagtgctcaaggacaccgccgccacctcgctgcaggatgcgctgcgcaccgtgccgggcattactttcggcgccggcgaaggcggcaacccgcaaggcgaccgtccgttcatccgtggcttcgatgcccagggcgacacctacctcgacggcgtgcgcgataccggcggccagagccgcgagatcttcgacatcgaatcgatcgaagtcagcaaggggcccaactcctccttcggcggtcgcggctcggccggcggcagcctcaacctggtgagcaagacgcccaagcagcaagacttcctcaacggcggcttcacctacggttccgaccagacccgccgttatgtgctggacgtcaaccgccagttcctcgacagcgccgccttccgcctgaacctgatgagccacgagcagaacgtggccggtcgcgacgccgtcaactacgaccgctggggcgtggcaccgtccctgaccttcggcctgggcaccccgacccgggtcaacttcagctactaccacatggaaagcgacgacctgccggattcgggcattccctacggctacagctcggccagcgccaccgcccacaagcacgacaaacccaccgacggcggcgacagcgacaacttctacggcttgaaggatcgagacttccgcaagacccgcgcggacatcagcaccgtctccatcgagcacgacctgaacgacaacatgacgctgaaaaacaccctgcgtcatggcaacaccggccaggactacatcctcacccagccggacgacagcaagttcaacgtcaacaagtacggcaccgtatggcgtcgcgccaactcgcgggtgtccaccaccgaaaccaccaccaaccagaccgatctgttcggcgaattccaggccctgggcttcaagcacacctactccacgggccttgagttcactggcgaagagacacgtgtcagcagctacaacatcgccggcaacaccgcgaaagtctgtaatccgggcagcatccccagctgcacctcgctgagcaacccgaacccggacgacgcctggaccggcgacatcagccgcaactacaacggcaccaacaccaaagccaccagccgcgcggcctatgtattcgacaccatcgaactcgatccgcaatggctgctcaacgtcggcctgcgctacgacaccttcgacaccgaggccaataccaacgccgccaccggacgcaccaagatcaaggacgacagccagttctggaactggcaggccggcctggtgtggaaaccgacggacaacggcagtgtctacgcctcctacgccacctcggcctcgccagcaggcggcctggtcggcgagggcgcggacggcaacccattgtccgccggcgccagcgtcagcgatctgcaaccggaagaaaccgtcaactacgagctgggcaccaagtgggacgtgttcaacgaccgcctgtccctgaccgccgcggtgttccgtaccgagaagaaaaacacccgcatcctggtcgatgccctgacctaccagaacgccggtgagtcccgcgtcgacggcctggagctgtcggccagcggcaagatcaccgacaagtggcaagtcttcgccggctacagctacctgaaaagcgagctggtggatgccggcctcaacgggcgtaacggggtcgtcagcgccggttcgaacaaaggcaatgaaatgccgaacacgccgaaaaacagcttcagcctgtggaccacttatgaagtgctgccgaagctgaccgtcggcggcggtgcgttctatgtcgacgaggtgtatggcgatgccggcaacaccgtgtatgtgccgtcctacacccgctacgacgccatggccagctacaagctgagcaagaacgtcgacctgcagctgaacgtgcagaacctgaccgacaagacctactacgacaaagcctactcggcgcacttcgccaaccaggcagccggccgtaccgccttgttcaccaccaacttccacttctgacgagatggaacgcgacgcctggcgcatccgggcgtcgtgtagccgctgccgaaggctgcgatcgaccccgcagggggcgcaagatcgtgaaatcgctggaggacctgcggtcctatcgcagccttcggcagcggctacacccacgcaagccccatccacttcggtgagtggggcttttgtgcgtaagaaagaatgtttctcgacaactcacggcataatgcgcgccgtggtacagacttaagaaccagcgaggcggtcgacgtgttgaagaaaaccctgttccagttgcactggtttttcggcatcagcgccggcctggtcctggccttgatgggcattaccggagcgacggtgtcgttccaggatgaaatcctgcgtgccctcaacccctccacactgcaggtggagaaacggccggccggggtcctgccgcccgccgagctggtggaaaagatccaggccgcctcgggcaagaccgtgtcgatgctcacggtggaagccgacagcggcaacgccgcccgcgtgtggttcaccccgccaccgggccagcgccgcggcgaaatgcgctatttcgacccctacaccggcgaattcatgggcagcgccctgggccaggacttcttcggcctgatgctgcaactgcaccgtttcctggccatgggcgacagcggccggcagatcaccggcgcctgcaccctgatcctgattttcttctgcctgtccggcctctacctgcgctggccgcgccaggtggcgagctggcgcgcctggctgaccctggactgggcgaaaaaaggccgcggcttcaactgggacctgcacgccgtggccgggacctggtgcctgctgttctatctattggcggcgctgactggcttgtcctggtcctacgagtggtacaacaagggcctgaacaaactgctggccgactcgccacaaagccaacgcatgaagaaccggggcgcgccgcccaagggcccggcgccgaccgccgattacaacgccatgtggctgggtatctacagcaccgccggcaaggacctgagttcctacaacatccgcatgccagcagtggccggccagccggcgaccgtgttctacctgctgaagaactcgccccatgaccgggcgctgaaccagatcactatcgacccgaacagcggcgtggtgagccgccacgaccgctacagcgacaagagcctcaaggcccagctgctgaccagcatctatgccctgcacgtgggcagctacttcggcattgtcgggcgcatcctggtgaccattgcttcgctgaccatgccgctgttctttatcaccggctggctgctgtacctggatcgccggcgcaagaaacgccagatcaaggacgcgcgccagggcctgagcgccgacaccggcgatgcctcggcctggctgatcggcttcgccagccagagcggtttcgccgaacaactggcctggcagaccgccgggcaactgcaggccgccggcgtaccgaccagggtccagccgctggccagcgtcagcgagcaggacctgctcaatacccagaacgcattgttcgtggtcagcaccttcggcgacggcgaagcgccggacagcgcccggggcttcgagcgcaaggtgctgggccgcgccctgtccctggacaacctcaagtacgcagtactgggcctgggcgaccggcaatacccgcacttctgcggttttgccaagcgcctgcatggctggctggccgagcatggcggcaacaccctgttcgccccggtggaagtcgacagcggcgacagctacgccctgcgccactggcagcagcaactgggccagttgatcggccaggcgccggtggacctgtggcaggcgcccgcctacgacaactggaccctgaaccaacgcgagctgttgaacccggacagcagcggttcgggcgtctacctgctgggcctcaccccaccgcagccaaacagctggctggccggcgacctggtagaagtgctgccgcgcaattgcgcgtgggccatcgagttcttcctcgacggcctcggcctggacggcagcgccacggtgcagctcgacggcctgacggaaaccctgacccaggccctggccagccgccagctcccggaaaaccgtgcccatctggtgggcctgcatgcccaagcgctggtggatgccctggtgccgctggccatgcgcgaatactccattgcctcgattgccagcgatggccagctggaactgctggtgcgccaggaacgtcaccccgacggcagcctgggcatcggctccggctggctcaccgagcatgcgccggtgggttcggccatcagcctgcgggtgcggcgcaacagcggcttccatctgccggccgagccttgcccgctgatcctgctgggcaacggcacgggcctggccggcttgcgcagcctgctcaaggcgcgcatcgccgacggccagcaagacaactggctgatcttcggcgagcgcaacgccgagcatgacttctattgcaaggacgagttgcaggaatggctggccgccggcgatctgcgccgcctggacctggcgttctcccgcgaccaggccgagaaaatctacgtccaggatcgcctgtaccaacaggccgaacgcctcaagcaatggctggccgacggcgcctcgatctacatctgcggcagcctgcaaggcatggcctcgggcgtggatcaggtgctcaacgaagtgctgggggccgaggtggtcgaacagctgatcgagcaaggccgctatcgccgcgacgtctactgacccactgatgctcctgtaggagcgaagcttgctcgcgataggccgaaggccggtagcggccttgataccgccatcgcgagcaatcgaggtcgaccggccgctcctacagaagcgggcatgtggctaaaccggctgcaacttgcgctcgaacaccgccaccccgtccaggtcccgcagcgtcaccttcaactccccactctgcccttcgatctgcacctcgccgaagaactggaacccggcgaacggcgaggtgttctgcgccggcggcgccttctggaacaccacctccgggccgaaggtctggtccagcgcgttgggcccgaaactgccggcattcaaaggcccggcgacgaattcccagaacggttcgaagtcttggaacgccgcgcggtccgggtggtaatggtgcgccgcgcagtaatgcacatccgccgtcagccacacatggttgcgcaccttgtgcttgcgcaggaacgccagcaactcggcgatctccagctcgcggccctgggccgggcccgggtcgccgttggcgatcgcctcccagcgcggcacgccggggctgacctcgccgtccggcacgccaaggccgatgggcatgtcggccgccaccaccttccactgcgccttggagtgcttgagcccctgcttgagccagtccagctgctcacggccaagaaacggcttggccgcgccaaggttgtcgtcgttgccaccgcgatagctgcgcatgtccagcacgaacacatccagcagcggcccgtagctcagtttgcgatagatgcgcccgccctggtcggcgctctgcaagcgcatcggcgcgtattccagccaggcctgccgcgcgcggcccaccagggtgtggatatctttgttggtgtagcgctcatccagcaccttgctcggcgaccagttgttgaccacctcatggtcgtcccactgccagatctgcggcacctcggcgttgaagcgccgcacgttctcgtccagcaggttatagcggtagttgccgcggtattcgtcgagggtttcggcgaccttgctcttggcctcggtggtgatattgcgccacacccggccgttctcggtggtcaactgcgccggcaccgggccgtcggcgtaaatggtgtcgccgctgtggataaaaaagtccggcaaacgccggcgcatggcctcgtagatacgcatgccgccaatgtccgggttgatgccaaaaccctggccaacggtgtcgccgctccagacaaaacggatatcgcggcgagtctgcggcacgctgcgcagatggccgaaccagggcttgctgcgcacgccggtctgcgcgtcctcgaaatacacccgataaaaaatcgcctgatcagtgggcaacccacccaactcgacccgcgcggtgaagtcggtgcgggcatcgaccaggggtgagacaaacttgcgcgggttgctgaaccggctgcgggtatcccactccaccaccatccgcgccggccggtcggtacggctccagaccatcgcccggtcgccgagcaagtcgccggactgcacgccatcgaccatcttcggccggtccttgggcgaagcgatcaccgccggcgccaaccccggcagcaacaaccccgcccccgccacctgaatcaaacgccgccgaccgagagtgaaatcgctcatggttgctccctgaccacctgtcaaaaggcaaccttagtaggcggcgatgaaggggatatgacaagggacggggctggcaaatgtcatggctgcaaaaacgggacgcggtgttattcccggcactggcggatgctggaggataggcgttggggctgcctgtacggcagtgaacgcctgttccgcgagtgcagacattcgttcaggctcgatcatctgtggcgagctgctcgtaatcgaatgctacctgcccgccgcagctgtcagcgtgtgctcattcagggtgattcaaggacggaaaggatcaggcccgccatttactgtggagcaggacagctcttggcggcggcctggagcgcctttgcgtagtccacgtaggtttggggatcgtagggttcaatggtcacggtaaagtgagacatgccgtcgtagccgattgactggtttacctccacagcccatgaccggccagcgtgctgggcgaccagatagaacgcatgggaattcaagtcgctactctcatccagagcagagtagagatagcgcagattcttataccagtcgcgattgcccgtaacagccttcaatgcctccttggcaggctgctcgtctacctctttcaggagggcattgccaatggtgagtctccctacgctttccagttcggagagtgggactggcagcggctcacggctgatcaaccgtgaatactcgcagtcgaacacccagcgtccggtcttcacgtaatcctcggcatagatcactacgccgttgcccaagtccgtcttgtatacactcgtcattaccttgagtccgtagttggccgcgatcagcagcaagggagaaataattgtgacggctatccagaagcctttacttcggtagaaactcaaaatggcctccaggtacgccaatgggcgtgctgcctgaaatcacaggattgatagctcccatggtctggtatgtgaagttcaattcttcaaaattatcctgacactcgtctttcagctgataccgtctcacctggacagcgtgcaagggggcggcctccggccggagatgttagagactgaagcccgcagaggtggagacaggtcggctgtttgaccaggctcgatgcgcagcacgaaagcctggcccgcagcgaagcgaagagcaacgctcggatccaggaagaaatagctgagcaccatggccagcggttttactgtgaaacagggcagctcttggcggcggcctggagcgcctttgcgtagtccacgtaggtttctagatcgtaaggttcggcggttatttcaaagctcgactctccgtcgtagccgatctcctgccagacttccagagcccatttccgaccactctgcgatgctaccaagtcaaaagtatggctattcagatcactgctttcacctagaaaggagtagcgataatgcagactcttgtaccagttaggtatcgccgtaattgctctaatggcgttttttgcgagtcccttatcggtctcattcaactcatacattttgccaatgatgagttttccagttcgttctagttctgctatcggtacaggcagcggttctcgactgatcaaccgagaatactggcagtcaaacacccagcgaccagtcttcacatagtcgtcggcgtagatcaccacgccgttgcccaagtccgtcttgtatacgctcgtcattactttgaatccgtagttggccgcaatcagcaacaaaggagaaaaaatgctaaaggctatccagaagcctttacttcggtaaaaactcaaagtggcctcccggtacgccaaggggtgtatcaccagaaatcacgggattgatagcgcccatggtctggtaagtgaattcgagtaaacgatggctattctttcgctccttttccagtgtttcccacttcctgcaccattctttcccaggtgctgcgttgccactgattccgcaaagatcgcccatgcggcgctcctcgaacgaaccccaggtgttcttgtagtccgagcgtcgaataaaggcgtgcaccttgatctgcaggtgattggccatcaactgcgccaggctctcattagtctgcgcaaagaactggataccatcttcgacggggaagtctgaccgattgcccatgccggtcctacaggcgtagctgtcgatctgcgccgaactggcaaacgccgaaggtgaaatcttctcgtagctcagtacgtccagggacatttggaagtcgccggcgagctgatagccgaaggcgatccgatgcggcacgccgtggctgaacagcgataggtgttggatgggtgattgcttgcggtccttgccctggttcatgtagtcgatcagttcctgaacgttggttacgccaataaagccagcatcataggcatcagcggattcacgtgccgcactgagcattgcttcgctgtatgacggggtgaacactaccagcgtccgcgccagggcgggcttgctgcgcttgaactcggccagttcgcgcacagcttggccgatgaacatcatttggttgcccgagcttgtgtcgtgctggctgccggcgactgcgattagctcgggagtcaacggctccttcggggttgttaaggacgaactgccaggttgcaccagagcgccggcgagcaaggcgcgctgctccagttgtgggtcggccaacagctcagacatcagttgatcattcactgagccgtccgggcgcacggcaccgagcttggcgaagtcaacgatagcctggattgctgcaccaccgaactggaagccgccgaaggtatcggggctgcccgaaatgattgttccaccgtgactggtagggctgcccaggtgagccattgggcgcccgttcaagatgatcgagggaaaccccgtggtaataaccgcaccacaaccgcagatgtcaccgactcgggcggcacccatgaagttgatgtttatgtcaccggaagcggaggtaatcgaggtggtgccatgaccgggaagtgggcagacgtgtttgtcacgcaggcgagcagaagagagcattcatcatccttgccttagctgatccgtggggggaggctctgattctttgcaactccccgaacctagcaagtggcgaaaggcaaggctgtaagacgattctgaactttgatgacgtggctgttttggtagttcgcctcttacgggtctacagacaaaaaaacgccccgaccgggatcgaggcgagctcccactctaccgaccattaacgccagtcgttaaagcgagttgggccataccttcaatgcgtttatggcagctgcctattcggcagtgaacactcaccccgcgcccatcggcaaccagcgggatttctaagctgcctattcggcagtgaacattcggatctggggcgccgatggttcgctccatttctaagctgcctattcggcagtgaacactggccggcggcatcttcgttacccgctacttttctaagctgcctattcggcagtgaactgacgcagaacttgagcgcgtcgcgtggatactttctaagctgcctattcggcagtgaacgttattggcagttcgaacgcggtggcattaaatttctaagctgcctattcggcagtgaacagttcaatggcgctgtatgtattcgccagttttttctaagctgcctattcggcagtgaacgctttggccttggcgtcagggccaggggtgaatttctaagctgcctattcggcagtgaacggcaagatcaagcacctgattaccggcaagactttctaagctgcctattcggcagtgaaccggcgctccagcagatggctgattgccttcgattctaagctgcctattcggcagtgaacttttccctcatcgatgaggccgcctggttgcttttctaagctgcctattcggcagtgaacgatgccatcgccgaccaggccagccccgtgactttctaagctgcctattcggcagtgaacatggttgattgcccggttgacgcggaccgtatatttctaagctgcctattcggcagtgaactagacaaatatcccaatagcaccatgatttcaaagagaaatcatgctgaacaccgtatttacccctcttttcggggacctttgtaagtgcttgatttacataggtccggaaccagctcgaaaaaaagggtcagcgtcagggaacagaacaccggcgctcagactagcgccatggatttgttttgtctggcccgaccagccgcgaatatcaagaaggatcgcggccagcgggccgttgccgatcagcgacgattgccgtcgagcaaggcatccaccacaccgcgcgccatttccacggaatgcaccagcgaccagatcaggccacgctcgataccgctggcgtgttcggtgatttcgtcggaaacctcctcggcggatttgagcagcatggacacgtgaagcaacgcctcttcggcgctgatgccgggacggacggtgaagagcgaatcgttacccgcaggccccgccgcggtgggtttcaaggcagcgagcaacgaaccttccaccggatgattggccaacgcctgacggacctgctcattggcctggtcgtggtctggattgcggcgtgagaacggcagggaaacgggtggatcggggacgagttttttcatggtgtggctcctcgacatgaagccaccacccaccgctgctagacggcatagaaaggtggcggctgtacgcgggctagcagaccgggtcaaggaaaccggcgcgcccgaaggcgctcccacgcacagtcgccataacagaacactgcaaatggaaaatgcagtgctgatggtgcgacttgcgtcttgacccgggctgctagacccgatcaccgaaaagtcagtgacgaacccgaggctagatagcgccgttaccagacgcaagcggcccgaagtttctcggaaaagccttacaaaagaaagcgaagcgcctcactttcagacagcgtcttacacgacaaacctgtcagccgcgggacctgatcgcgagcaagctcgctcctacaaaaggctccgatataaccgcgatctctgtagccgctgccgcaggctgcgataggaccgaaggtcctccagcgggctcaagatcctgcgcctgctgcgcagtcgatcgcagcctcgcaggctcggcagcggctacagggtttaacgtcggccacccggccaccatcaaaccgcaacatcgcttttgctccggctccggctccggctccggctccggctttggctttggctttggctttggctttggcttttgattctgctcttgatccacccgccccatcggaaggccgagtggaggtgttcatcagggggatggcgcgcagcgcccctcgacgtagtcgaggacatcgtatggaggtcgaagcgaagccgaccggagtcgatgccccctgatggacgccggagcgagggaacctgagcgcagcgaaggccgtacgcaggggcaagcgttttttggttactttttttggcgtttgaaaaaaagtgactcgccgtaagggcgaaaccgccaggagccgtgaccgcagaaatggatatgtaccccgtccaaaacaagcagcgaaaccaccgccgccatcgcaggcaatcgaacgtcgaccaaccactcctacagagtcagcaatcaccagaaacaacaatggcgccacccgggcgccatcgaagtcaacgcagaacagccgtcaagccttgaccggctccaacgtcagctcagccgcctccggccgcttcaccaccgcatacaccaccgccgtcaacaaactccccgccacaatcgccagcaaatacaacaacgcatgattgatcgcattcggaatcaacatcacaaacaacccaccatggggcgccatcagtttgcagccgaaatacatcgacagcgccccggtcagcgcgccgccggcgatgctcgccgggatcacccgcaacgggtccttggcggcgaacggaatcgccccttcggagataaagcacagccccagcaccagcgccgccttgccggcttcacgctcgctctgggcaaacttgcgccgggcgataaaggtggcgatgcccaggccaattggcggcaccatgccggcggccatggtcgccgccatcggtgcataactctgcgacgccagcagccccacggagaaggcataggccgccttgttgatcggcccgccaaggtcgacgcacatcatgccgccgagcaacacacccagcaggatcgcgttggtggtacccatgctgtcgaggaagtgggtcaggccggcgagcattcccgccaccggcttgccgaccacgtagatcatcaccaggccggtgaacaggctggccagcaacggaatgatcaggatcggcttcaaggcctccaggctctggggcaagcgcgcgtatttactgatggccttggccgcatagccggcgatgaaaccggcaatgatcccgccgataaagcccgcgcccagggtgctggcgagcatgccgccgatcatccccggcgccaggcccgggcggtcggcgatggaataggcgatgtaaccggccagcagcggcaccatcagcttgaacgcggtgtcgccgccgatttgcatcagcgccgcggccagggtcccctcctccttgaacgcggtgatgccgaagacgaaggacagggcgatcatcaagccccccgccaccaccatcggcagcatgaacgacacgccggtcagcaggtgcttgtagaccccggttttctcctgcttggccggcgccgcgccagcgcccgccgctgccgattccacctggccttcggccagggccttgttcagggtcgcctccgattgtttgagggcgatgccggtgccgcagcggtagatcttcttgccggcgaagcgctcggtgggcacttcgatgtccgcggccagcagcaccacgtccgccgcggcgatggcttcggcgctcaacggattgcgcgcgcccaccgagccctgggtttccacttgcagctcgtaacccaggcgcttggcggtctgctgcaaggcctcggccgccataaaggtgtgggccacgccggtcgggcaggcggtgaccgccaccagccggggggcgttcttgctggccggcgccggctcggccacggcttcggccgcgacatacacctgggcctcctcggcgccacggcgcagcacgccgtcgacgtcctgcagggccacggagggcgagctctggaacacccgtttgccgacgaaacgcgacatatccaaaggcccggtgctgaccaccagcacccactcggccgcttcgagggtggcggccgacaattgccgttccgggtgcgcctcgtcatgcacttcgacgctggtgctccagccctggcgctgggccgcggcgtccagcaaccgggcgcacagcacactggtgaccatgccgttcgggcaggcggtaacaatggctaacttcatgaccaaccctcttattgttctatgaggggatgaacgcgcaccccctgttcaagctgtgccaactgcgcggcatcggtgatgccgaaaccgatctgggtcacggccatggcggcgatggccgtggcggtgcgcagggtctgttcaaaagcgtgggcactgagcaggccgtggagcatgccggccagcaacgagtcgccggcaccgacggtgctggccacgctgaccttcggcggcaacgcctgcagggccggcgcggcactgaaccagttcacgccttcggcgccatgggaaatcaccacatgctcgacgccctgggcgtgcaggcgcctggcggctgcggcctgggtcgccagcgacagcagcgggctgcccagggcctcggccagttcctcggtgttcggcttgaccagccagggcccggcgtccaggccggcgcgcagggcttcgccgctggtgtccagcgccactttcaaccccagtgccttgagacgggtcagcaaggcgtgcagccattgcgggctgacgccgcgcggcaggctgccggccaccaccaccgcgtcatgccccggggcgatctgttccaggcgctcgagcagcgcctgttgcgccgccgcgtcgacctccgggccggggccgttgagatcggtgatgcgcccatcctgttcggccagcttgatgttgctgcgggtttccccgggcacgcgaataaaggcgtcgacaaaaccgcgccgggcgaacaacgcctcgaaggcctggggattgtctgcaccaagaaagccgctgacggtcagctgatggccaaggtcggccagcacctgggccacgttcacacccttgccggcggcgtgagtgtgcatggcttcgctgcggttgacctgccccggctccaggcgcgtcagctggacggtgaggtccagcgccgggttcagggtcagggtaagaatctttgccattacatggcctccacaagggcgcgcacatcgttcgcgctgccgacggccagggcctgttcagcaagggtttgcgcctgggtcaggctgagttcgcgaatgcgtgccttgacctcggcgatgctgcgtccggagacgctcagttcatccacacccaggccgaccagcaccggcaccgccagcggatcggccgccagctcgccgcacacgccgacccacttgccgtgggcatgggccgcgcgcacggtgatgtcgatcagttgcagcaccgccgggtgcaggccatcggcctgggccgacagggtcgggtggccacggtcgatggccagggtgtattgggtcaggtcgttggtgccgacgctgaagaagtccacttccttggccagcaccggcgccagcaaggcggcggacggcacttcgatcatgatccccagttgcaggtcggccaccgggatctccaggcgcaagcgctcggtcatatcgcgggcggcgcgccattcgtcgacgctgccgaccatggggaacatgatccgcagcgggcggttgtccgccgagcgcagcagcgcgcgcagctgggcttccatgatctgcgggcgttgcagggtcaggcggatgccgcgcacgccgaggaaggggttttcttccttggcgatcggccagtacggcagcggtttgtcgccgccgacatccagggtgcgcaccaccagcggccgcccggccaggccatcgagcacccggcggtattcggcttcctgggtggcttcgtccggcgcttgcgggtgggccatgaaaatcagctcggtacgcagcaggccaatgccttcggcgccgttttccacggcgctggtcacgccggcgctttcaccgatattggcgaagacctcgacgtgatgaccatcggtggtgtgcgccagttcatggcgctgttcggcggcggccttgagccgttgctcgcgggtatcacgctcttcggtggcccgttgcagggtgccggcatcggcgtccacatgcaggcgaccgcgctggccatcgagcagcagcggcgtgcccggtttgagcagcagcacgccagccccggcgccgaccagcgccggaatccccagggcgcgggcgacgatcgcgctgtgggcggtggcgccgccacgggcggtaagaatgccggccacccgcgccggatcgaggcgcgccacgtccgacgggccgacctcatccatcaccaggatgtagggttcatccggctcgaccggggtctgcacgccgcacagctgggccagcacccggcggccgatgtcccgcaggtcagcggcgcgttcggccagcagcgcatcgtgcaaggcttcctgttgccgggcggcggcttcgatcaccgtcatccaggccgcggcggcgctttcgccctgcttgaggcgggtgtcgacttcgtcggtcagttccgggtcgtcgagcatttcctggtgggtcacgaaaatctcgcgaatcgccttggccttgctgcgctggatcaggccgtcgatgtcctggcgtacctcggccagggcctgttgcaggcgttcgcgctcgctggcggtggattcgccgcgcaacgggtaatcgaaaggctggatcacctggatatgcgccgggccgatggcgatgccgggcgccgccgggatggcctggaccaggctgccggaagccggcgcgctgatgggcacctcgatttcttccggcacttcctggggcgcgctggcttgcgccaccggctcgacttcttcccccagcccttcggcgatggccgccagcaaggctggcagggcgtcggcggcgatgttcggttcggcgatcagctccagggtctggccacggcgggcgccgaggctcagcagcttgctcaggctcttcaccgagacggcggagcccggtgtgtcgaggatgcgcacgcggatctcgccctcgaagcttttcgccaactgcgccaggatcttcgccgggcgcgcatgcaagccgtgggcgttggccagcacgatgcgcgcgctcggccagtcggccggcaattcgccgcccagcacttcaagcaccgcacggctgctggtggcccggcccagttcatggccacggccttcgatcagcagcgcgcacaggcgctcaagcagggcctggtgggcctcgcccaggctggccaggcagaacagcccagccagaggctggccgagataacgaatcggtttgtccggggtgacgaaggccaggcccgggcgcttgacggtctgctcgctgtgcagccaccacaggccatcgcccaggggcagcgcctcgacctgttgcagcacggcggcaaaaccgttgctgacgcagtcggcctggcgcaacagacgggcgccgcgccataccagttcttcgaaatcttcggcggccacgcccaggccgatcatctgcgcatccagcgccagctcctgcggcgcgccttgcagcagtttcagcagggcttcgggcgagctggcgcgacgcagggcctggcccaggtcggtttcgccgagggcgcgggtcaagagttgcagcaggcgcaggtgttcgtcggatttggcggcgatgccgatcgccaggtagacgatctggccatcgccccagtccacgccctcgggaaattgcagcaggcgcacgccagtggcgaacacctggtcgcgggtttccggggtgccgtggggaatggcaataccttgaccgagaaaggtcgagccctgggcttcgcgggcctgcaggccagccaggtaaccttcggcgaccaggccgtcggccaccagtttgtcggcgagcaggtgcagtgcggcggacttatccacagccgactggcccatggatatctgctcaatagtgagctcgagcatgctttctcctatttagcgctggggcgctaggtattgttttgagtgaatcagccaggcggcgttaatgccacaaacgggaccgtcggcttggcaaggccctgtttccgtttgctcatattcctagaaaatacgcgtgctgaaacgtttaatctacaatgacgggcacgttactcgataatcaatcatccttgaagtcctacctgtcggttgcacgttccgacattggtcgcctgcccatatcggttaggattggcgaaaatgtcggggcaagctccagaaaacaaggaaaacccgggttgaaactcagcgatatcgccagactggccggtgtgtccgtcaccaccgccagctacgtcatcaacggcaaggccgaacagcaacgcatcagcaacgcgaccgtcgaacgggtccgggcggtggtcgaggagcatggcttcacgcccaaccctcaagccgccgggctacgcagtcggcggacccggaccctgggtttcatcctgccggacctggaaaaccccagttacgcgcgcattgccaagttgctcgagcaaggcgcccgcgcccgtggctaccagctgctgatcgccagctccgacgatgccccggacagcgagcggcagttgctgcaactgttccgcgcgcgccgctgcgatgcgctgttcgtcgccagttgcctgccgccggaggatgacacctatcgtctgttgcaggcccagggcctgccgatcatcgccatcgaccgggtgatggagccggagtttttctgctcggtgatcagcgacgaccagcaagccagcctgcaactgacccgcagcctgctgcagccccagccgcggcagatcgccctgatcggcgcccgccccgagctgggcatcagccgcgagcgcgccgccggcttcaaacaggcgctggaaggtttcgacggccaggtgctgatcgaacagggcgaagccttcagccgtgactgcgggcgccagttgatggtagcgctgctggagcgcctgggccatctgccggatgccctggtcaccacctcctatgtgttgctgcaaggggtgttcgacgcgctgcacgacttcccgctcaagtcgcggccgctgcgcctgggcaccttcggcgatacccagttgctggactttttgccgctgccggtgaatgccatggcccagcaacaccagctgatcgccgacaaggccctgcaactggccctggccgccattgaagaagcccattaccaacccggcgtcaacgccatcgcccggaccttcaagcagcgcattcacgaggcttgaacgtggaactgatcgacagccacacccatctggattttccggatttcgacgcggatcgtcaggcgctgctggctgccagccgcgccctcggcgtgcggcggatggtggtactgggggtttatcagcgcaattggcagcggctctgggagctggtgcagagcgatgccgacctgcacgccgccttcggcctgcacccggtttatctcgacgagcacagcccggccgacctggttgagctgggcgactggctgagccgcctggcgggccacccgcagctgtgtgcggtgggtgagatcggcctggattattttctcgagcagctggatcgccagcgccagcagcaactgttcgaagcgcaactgcaactggccgcggacttccagctgccggcgctgctccacgtacggcgcagccatgccgcggtgattgccaccctcaagcgcttcaagctcaagcgcgccggcatcatccacgccttcgccggcagccgcgaagaggcccgcgaatacatcaagctggggttcaaactgggcctggggggcgccgcaacctggccgcaggccctgcgcctgcgcaaggtcatcgccgacttgccgctggacgcggtggtgctggaaaccgactcgccggacatggcgccggccatgtaccccggccagcgcaacagcccacagcacctgcccgacatctgcgcggccctggccgagctcatggccatcagccccgaacagttggcggcggccagtaccgccaacgcttgcgagttgttcggctgggcgcaacgcgcctgaatcagacccggaacgcgctgatcaactgcttcaactgcaccacctgcgcggacagctggcggctggcgttttcagtctggtacgcgccttcggcggtgcgctcgccggcgcggttgatctcgacgatgttctgatcgatgtcgtgggccaccgcggtctgctgctccaccgccgcggcgatctgctggttctggtcgacgatcatgcccaccgcgccgaggatgttctccagcgcctgctggaccttttccgactgcccgaccgtgccattggccatctcgtggctgatgcccatggccttgaccgccgcccccacgccgccgtggagcttgacgatcatctgctcgatttcctcggtcgattgctgggtgcgcttggccagggtccgcacttcgtcggccaccaccgcaaagccccggccctgctcgccagcgcgggccgcttcgatggcggcgttgagggccagcaggttggtctgttcggcaatgctcttgatcacctccagcacccggctgatggcctggctgtcgctggccagctgattgatcaccagcaccgactggtcgatctcgctggccaactgggcaatgctgccttgttgggattccaccagcccgcgcccgctgatggtctcgtcgttgacgctgtgggcgctgctgaccgcggccgcggcgctgcgcgcgacttcctgggacgtggcggacatctggttcatcgccgtcgccacctgctcgatctggctgcgctgcccggccaccgcctggttgctctgggccgacacggcttccacctgcccggcctggtgctcgacttcgccgacggtcttgcccacccgctcgatcaggtcgtggatcttcgccacggtgccgttgaacacagtgcccagttcccccagctcatcgcggctctgggcatcgaaggtgacggtcatgtcgccagccgccaccttgtccatcatcgcgcccaggcgcttgagggtggtacgggtcgagacgtagaacgcgccgtagagatagaagatcagcaggaacaccgccgccagcgccaccaccagcagcaccatgtgcgtgcggttctgcccgagccgctgctgcagctcttcgccgagaaacttcagggtcgcctcgttgagctggtaggtctgcgccatcagcccgctgacctgatcgtaaaagccctgccagggtgcatccagggtatcggccatcaccacctggtcttcgaacagctcgctggcttgcttgaggctgcccttgctggcgctggcctgggcgtccagcgcgctctgggcggccttgctcgagcccagcgcatcctgcagtttcaggccgtattcggcctggagcttttcgatctgcaccagcaactcgtcgaaacgggtgctggcggatgagttgagaaaaccctgacccagggaatacgcgcccatcgcccggccttctccgaggacctgcgtgacctggggcgtgacgctggtcagtagttcgctcaactgccgcacatcgctctgggtatcgcggctcaggccggactggctggcgatgatctggctgaaaatctgcgcactgcccaggagcttgccgatcagcgcgcttttgctttgcagcgagctttccgcctgttgcgccttgaaggcggcgatcatttcatcgcgcttgccgtcgaacacgccgatctgctcggggtccacggtgactgcggccaggctctgcaagcgctcaagcacagacttttccagggtgcctatcttgctctcgatatccccggccttgccggactgccccagggtcgcgttgatctgcaccatgttgttcagggtttccaggtcgcggcgcagggtcaggctgctgcccagcaggtccaggctttgcagctcgacctgggtggcctggaattcacggtaggaatcgcgcaccagataaaagttggtgaccagcatcggcaggaaaaacagcacgctgatcaagctgaacttcatgccgaagctcaggcggttcatcagggcaatggcgggatagagcaagctcttcacaagaagtctccctttttgcttttatttttattggcaggtacgcgaagacggcagatagccactatttggcgctgcttctgtatagctcaaatcggcaaaagggtttgtaacttaaggttaaccgcggggacggcggacggatggaaggcttcagttgcgctggcgagaccggggctcgccagcgctcagtcgctgctcgtcgtcagggcagcacggtccacagggcgaaaccggcgtaccagagcaccgcggcccgcagcaacagctcccagatccggtccaggctgacaatgccgtccggcccggtgatcggcgtggggatttccgcggcgaccaggccgaccttttccaccagctgcgcggcgctgatgttccagttcagcagctcgtggagcatcacgcggctgaccgcgacgaagttgcccaccagggcgaaactggccgccagcaggcgtaccggcaaccagtcgaaggcatgccgcagctgcccggcgcgctcggcgaccgccgggttcttgctgtgctcggcggccagcgccagcaggcgataactcaatgcggccaccgggcccagcaggaagtaccagaagatcaccgcgaaaaagctctggtaggcctgccacagcagatgcccctgaacccgctcgagtaactgctcgccactgtcggcacagatatccaggtcgcgcttggcgacatgcgccgcggcttgcaggtcttcacggcgccaggcatcgcggaacggtccgagttcgcccaacaggtcgccccgccccaggctgtagatcaccaccagcagatgcaccggcaacgccagcaggccgtaggccagcggctccaggaccagcaacagcaaccccagcagcactgccggcaacagcaccagcagcgccagcacccaccagggatgcttggccagacgcgggctggcctcctgcccaagcaattggcgcagccacggctcgtcatgctgaacgcgctggcgcaaggccgagaacttctcgatccagaccgccagcaacaacaccagaaaactcattgtccttccccttcgttcagggccgcgcgatagcgtacccagtcgaatccgggccccggatcggtcttgcgccccggagcgatatcgctgtgcccacaaatcctctgtggggtgatggccttgaaggcctgccgcaactgccgggtcaaggcaatcagcgcgtcgtactgggcatcggtgaatggcagctcgtcggtgccttccagttcgatccccagggaaaaatcattgcagctttcgcgcccgtcgaaccacgacacgccagcgtgccaggcgcggtccagacaggagacaaactgagtcacggttccgtcacgttcgatcaaaaaatgcgcggacacgcgcaggtcggcgatcccggcaaaataggggtgctctgtgacatcgagacggttctggaagaattcctgcactttgcccgtcgcgaactgggccggcggcaggctgatgttgtggatcaccagcagggaaatttcatccgcggggcgtgcgttgaaattgggtgacgggcaatggcgaacgccgtgacaccagccgcttgcggggtccaactgcataccgattccttcaacgaagcctgtgacggctcagtatgccgcgttccacgcccaggttgcgatcacttgccgcgattgagtcgctgcaaactgccgatcaccgattccagcgcccggtcgaacagcaaggtgtcgtccagctcacgcacggccccgcgctgaaactccagggccaggccgacccgggtgcgctccaggaccttcatgccggtgcggttgacgaagatgtacttgtcgccgggttgcacgatggccgccagcttgcagcgcacgctgttgtcctcgtcctcgaggaattcgacccaggcccccagccgcagctgttcgacccgcagcaacccgggatcgttggccgccagcgccaggggcgcggcctccagcgggccctcttcagcactgggcaggacgatgtgttcctcgaccgcgaccatcgccggctgctcgtccgccacgcccggccgatgctgcccggcgttctgagcaaagtgctcgaacgcttgcaggtgcaaggcttccaactggctgaagaactcgctggtggcgaatggatcgaacgccgcgctgttcaagccgtcgcgcagcgccttgagcaggtcgggcaccagcgccagcagttgcatggcggcatccggatcggtgtgacgctgcacgctccagatcagttgctccatggtctgcagcccctggcgccattcgctggactgctcgccatgcttgagacaggtcagcagcaagaccttgctccaggcctgttgcacgaactcgacgaccgtcagcggcaggaccttgcccagcaacccctcgttcaacgcctgctcgacgcgacggcgcgccagttcagccttggcccggccctcttcggcgtcacgggtgcgctgttccagcagctcgctacgacgccgctcgtcactggtgaaggcgagaaactcggcgagcagctcggaaaagatcgccgggtcgtcgacgaagtcgctcaacaaccgctgcaccacctgctcgatacgcaggtacaggctgtcgcgctgataatcgtcgcagctgccccagcccatggccgccgcggcgatttcattgagcaggcggcgcgcgggatggctgctgcggcagaagaaactcttgtccagcaccgcgaccttgagcatggggatctgcaagcggccgatcagggtcttcaaggactccggcaggttgcgatcggccaggatgaattcgaagagcatggccaccagattgatcacatcctcgtcggccactccgaccacccgcgacttgccactctttacgctgacccgggtcaacagctgttccagctggttgcgcaggtcgaaatcgtcctgggcgctggccggcacgtagtgctgcaggtgagacagcaggcgcagcaggtcacgggtggaaatgggctgggtttcggcgctcgcctcgagggtcggcaccacgctgccgcggacatgcaacaacagctcctgcaaggcggagaacacttgctgaacgctttcgtccatctgcgccacgccgggctccggcgtgacctggatactcgcggccgcctgatcgatagaccggcgcgccggcgcgggcttgagctccggcaacacgcccgtggcggccaacagctgattggcttcggcgtacagctgatcggcttcgctgagcacataacgttcgaacagtttgagaatgatcagcttgaccttgatctccacccccaggctgcgcccggactcgaggaaatactcgcagagcatggccgggcccaaggggttgctgcggtcatccaggtgcttgcccagcagcgcgctcaggcgcgcggtgagctggccaagggcaaaaccgtcgcggttgcccgccttggcgaccatcgcctcgagggccacggtgcgctccaggtcatcctggcaggtgtcagcgggtgggacgtaggcgacggcctgggcgatcgcgggcgcggggtcgtactggaccaggtcgacaaaggcctcgaagagtttttccaggaagccacgctcgatgcttttgcgtttcaggcgcaggtcgcgcatggcttcgaaaaaggtgttctggtcgacattgttctgggcccggtcggccatctcgaacaaggtgtcgtcggcgttatcgaacagttcctgcaggccatggcgcagttgctgggcggccttgtcacggacctgaagcagaatcacaggcaggcgggcgagcggcgaagggttcgcctgatccgtagcggccttgtgcaaaggcactacattcccgtcgttgtgcatccaagcctcctgaaaggtttttctctgccgcgcaagaaaagatcggtcgacgctcacagtcgagtcccagcgggcatcgatacgcaccgctgcatttcaaatagtggggagccaagcaaacgtcaaagctatgacgtcaattagaagtcggattatctggcaaaagctccttcttgtgccagcagactctgcgcgggctttgaaatagcgctcatatagcgaccgccctttctcgcaaacggctcatgccaggcgaccaaatgcaggtactggaggggcgccgccttgggttcgcttgcgccatggccctataatcgggccactttgtttgtggagcccgctatgccgaatctacgcctcgccgacctgaccgccgaaatcgaagccaacgtgcgccgtgcgttgctggaagacatcggcagcggcgatatcaccgcgcaactgatcccggccgaacgcctggccaaagccaccatcattacccgcgaagcggcgatcatcagtggcacggcctgggtcgacgcggtgttccgccagctcgacccgcgggtcgccgtgcattggcaggtgcgtgacggcgagcgcgtcagccccaaccaggccctgttccacctcgaaggtccggcccgttcgctgctcagcggcgaacgctgcgccctgaacttcctgcaactgctgtccggcgtggccacccgcgcgcagtattacgccgacttcgtcgccgatacccaggtcaagttgctggatacccgcaagaccctgccagggctgcgcctggcgcagaagtacgcggtgacctgcggtggctgccacaaccaccgcatcggcctgtacgacgccttcctgatcaaggaaaaccatattgccgcgtgcggcggtatcgcccaggcgatcagcgccgcccacaagatcgccccgggcaagccggtggaagtcgaagtggaaagcctggaagaactcaaggaagccctggcggcgggcgcggacatcatcatgctcgacgagttgagcctggacgatatgcgtgaagcggttcgcctgaatgccggcaaggccaagctggaagccagcggcgggatcaatgaaagcaccttgcgcccgatcgccgaaaccggcgtcgattacatttcgatcggggcgatgaccaaggatgtgaaggcggtcgacctgtcgatgcgcttgagcctctgactttcaaaagcctgcgcgctaccccaaagaaaaacgccagcccctgaaaggctggcgtttttgcatcagtcgtcgatttcgttgagttccaggtagtcctgaaggtccatgcccagggcctcagcgacttcctgatggacctccaggcgcatggccttgagttcctcgggcgactcggcgatcaattccagcacaagctcccacggctcgatgccgcgcgactccgcttcgtcctcgaacgcccactgggcctgctgcttctgctcctgcgggctcagggcgctgatttcttcctgcaaggaaggcgtggcagccaggtacttttcaagggctacgtcaattctggcttctttaggaatcatctcgttctctctgatcatgggaatggaagatggatctggatcgttgggatctctttgccgcaaaaaagcgctgtgaaagccgatttatctggccgtgaaccattcgggatcatctgaaaaccattcagacaggctgcgaatatagggcctttgtctgcggatgcatacgaatccttacagcgcaccgacaaaaaacctgtccgttcgctcaaggcactttcacgaaaaatacgttgttacattcctctccccgagcaaccttcttgcccctggaacaagaaggcaggaacgcagtcatagcgatgtgccatatcggcacttcacaaggaaacccagtgatgttcagccgcactcagcgttcgtccgccttcctcgccaccagcctctctaccctgatcctcagcagcctgtcactccccgcccaggccgtcgaattcaactccagcagcgcctcgtactcggacaggatctcggccctgcaccaggaagtagacctcaagtacaccgtgcgccccagcggcttcaccgtggacgacctgcaaaagctgcaggatggcctcaagagcagcagcgtcgagctggaaaagctcaaggacgtcgtcaacagccaggcgcgcctgatcgaagagctcaaacgcaacaccggcagcagttccagctccactgccagcgaggtgagcaacctcaagaaaaccaccggcgagcaagccaaccagctgaagaaactggaaacccagcttgaagagttcaagcgcaacagcggctcaagctccagttcgagcgccagtgaagtgaacaacctcaagcgcgttaccagcgaccaggccagcgaactggacaagctcggcaaacagatcgaggagctcaagcgtggcagcagttcaagctccagctcgaactccagcgagctgaacagcctcaagaacacggtcagtagccaggccagtgaattggacaagctcggcaagcagatcgaggaactcaagcgtggcaacagctcaagctccggttcgagctccagcgagctgtccaacctcaagagcacagtcagcagccaggccagcaccctggataagctggcgagtcagatcgatgacctcaagcgcggcagcagctcaagctccagttcgagctccagcgagctgtccagcctcaagagcacagtcagcagccaggccagcactctggacaagctggcgaatcagatcgatgacctcaagcgtggcagcagctcaagctccagttcgagctccagcgagctgtccagcctcaagagcgaggtcagcaatcagggccagaacctggaccaactcaaacgcagcctcgaggatctgagaagcaaggtgaagtgattcaaggccaataaacacgacaaagcccgctcgatgcgggctttgttgtttatacgtcttgaactgccaactggtgcccgagacaggaatcgaacctgcgaccttcgcgttacgagtgcgctgctctaccggctgagctacacgggcgctgggctaaacctagcaccgggaccggggttttgccatgtcgccggcccgacagggagcaaagcccaaacggcagatagcaaaacgccccgaaccagtcggggcgtttgcttgttcagcttacagcgtcaggggtcttaaacgcccgaagccttggctgctgccacatctttgatggacagtttgatacggccgcggttgtccacgtccagcaccagcacttccacttcctgaccttctttcaggatgtcggtcactttctcgacgcgagcatcgctcagcatggagatgtgaaccagaccgtccttgccaggcaggatgttgacgaatgcgccgaagtcgacgatgcgctcaaccttgccaacgtagatcttgccgatctcggcttccgcggtgatacccagaacgcgctgacgcgcagcttctgcggcttccttggtttcgccgaagatcttgatcgagccgtcgtcttcgatgtcgatcgaagccttggtctcttcgcagatcgcacggatggtcgcgccgcctttaccgatgacatcacggattttgtcggtgtcgatcttcatcgcgatcatggtcggagcgttggccgacagttcggtacgcgactggccaatgatctggttcatctggccgaggatgttcaggcgagcttccagggcctgacccagggcgatctccatgatttcttcggtgatgcccttgatcttgatgtccatctgcagcgcggtgacgcctttggcggtaccggctaccttgaagtccatgtcgcccaggtggtcttcgtcacccaggatgtcggtcaggacggcgaatttctcgccttctttaaccaggcccatggcgataccagcaaccggcgccttcatcggcacgccagcgtccatcagtgccagggaagcaccgcacacggaagccatggagctggaaccgttggactcggtgatttccgataccacgcggatggtgtaggggaacacgtcggcggctggcagcatggcctgaaccgaacgacgggccagacggccgtgaccgatttcacgacgaccagcgccacccatgcgaccacactcgcccaccgagaacggagggaagttgtagtgcagcatgaaggggtctttcttctcgccttccagggtgtccagcagctgtgcgtcacgggcggtacccagggtcgcgacgaccagggcctgagtctcgccacgggtgaacagggccgaaccgtgggtcttcggcagaacgccgacttcgatgttcagcggacgtacggtgcgggtgtcgcggccgtcgatacgtggcttgccgttgacgatgttttcgcgaacggtgcggtattcgatttcaccgaaagcggctttgacgtcggcagcggaaggctggccttcttcgccggacagcttggcgacgacctggtctttcagctcgcccaggcgtgcataacggtcggccttgacggtgatggtgtaagcctgggagatcgcttcgccgaactcggagcggatagcacccagcaggtcggtggcttctggagccggagcccagtcccaggtcggcttggcggcttcggcagccagctctttgacggcctggataacggcctggaattcgtcgtgggcgaacagtacggcgcccagcatctggtcttcggtcagctctttggcttccgattcaaccatcagtaccgcttcttcggtaccggctacgaccatgtccaggctcgaggcagccagctgctcgtaagtcgggttcagcagatagcccgtgctttcatggaaagcaacgcgggcagcaccgatcggaccatcgaaaggaatgccggaaatcgccagcgcagccgaggtaccgatcatcgcagcgatgtccggatcggtcttcttgctggtggaaaccacggtgcagacaacctgcacttcgttcatgaagccttctgggaacagagggcggatcgggcggtcgatcagacgcgaggtcagggtttctttctcggaaggacggccttcacgcttgaagaaaccgccagggatcttaccggcagcgtaagtcttttcctggtagtgaacagacagagggaagaaacccttgcctggatcggcttgcttggcgccaaccacggtcaccaatacgctgacgtcgtcgtcaacggtgaccaatactgcgccggaggcctgacgggcgatacggccagtctcgagggtaacggtcgactgaccgaactggaattttttgattaccgggttcacggtgtcctaccttctttgtggctcttgggggaactggtttcttgcgaaattcttgggcaatcccgggaatcggcccggcctttattgtccaggtaaaactacggtccagataaaacttgaggctgggagcctgccatgcgcctgcgggaaacccactgacgcacggcaaacaaccaacctctagcgcaatcgctgattagcgacgcagacccaggcgaccgatcagagcgctgtaacggctcaggtctttgcctttcaggtagtccagcagcttacgacgctggttaaccatgcggatcagaccacgacgggagtggtggtctttaccgttggccttgaagtgaccttgcagtttgttgatgttggcggtcagcagtgcaacttgcacttctggcgaaccagtgtcaccaacagcttgctggtagtcggttacgatttgagctttttcttcaacgctgagtgccatttggctttcctctcaaaaggcaacgttccgagaaacgccaccaacaggccagggacaaatccccgtatctataaatgagctgtgaccgtgcctgttaacagccaccctctccagcctgctgttacacaggctggtttccggtcattccgaccgaatcagtcgacgcggcgcgatgcgcccgtcttcgctcacttcaccgataccgataaagcgaccgttatgatcctgtacccgcaccatgccgaacttcggtgcatcgggagcccgtaccggctggccgttgagccagtagaacgcgctgtgctcggagaactgcagcagcggccaatccagcaggccgctgtccgctggcatcaggaagcgatccaccgcttcgttaccgccttcggcatgtaccgcttcaagctcttccagcgtgacggtctgggccagactgaaagggccggcctgggtgcgacgcagttccgcgacatatgcaccacaacccagcttctcaccgatatcctccaccagggtgcgaatataggtgcctttgctgcagtccaccgctagccgcgcagtatcgccttcaaaggccagtaattccaagcgcgcaatagtaacagaacgcgcttcgcgctccaccacttcgcctgcacgggccagcttgtaaagtggctggccatcacgcttgagggccgagtacatcggcggtatctggctgatttgcccacgaaattccggcagcaccgcttcaatatcggcgcgaccaacggtcacttcgcgagtctgcaggacttcaccctcggcatcggccgtggtggtggtcttgcccaactgcatcagggtttcgtaacccttgtcggaatcgagcaggtattgcgagaacttggtcgcctcgccaaagcacaacggcaacacgccggtggccaggggatcgaggctgccggtatgcccggccttctcggcgttgagcaaccagcggactttctgcagcgccgcgttggaagtgaaccccagcggcttgtcgagcaggatgataccgctgacgttacgacggatacgcttgacctgagccaccgcttactccttggcgtcttcgggtgtagcggcgtgctggctgtcttcggccacggcgcgctcgatcagggccgacagatgcgcaccccgcacgacgctttcgtcgtagtggaagtgcagctgtggaacgctgcgcaacttcatctcgcgagccagctgcatgcgcaggaagccggcggccgaattgagcaccttgatgctctgagcgatatcgtcagcgttgtcctggcccatcactgtgatgaagatcttggcgtgaccgacgtcacggctgacttcaacggcggtgatggtgaccaggccgacgcgcggatctttgacttcacgacggatcagctgagcgagctcacgctgcatctggtcgccgatacgttgggtgcggctgtattcttttgccatgtcttgttacctgttgctgcctcgcggtgaaacccgcaaggtctgaaagcggcaaacgcccggcctgacagaagccagaccgggcgttgcgtttagagtccggacgatgcgccgtgcattttcatgcaactggccatcatggctcttgaagtgcgcgagttagaggctgcgagcaacctgaaccttctcgaagacttcgatcttgtcgccgactttgacgtcgttgtagctcttcacgccgataccgcattccatgccggcacgcacttcggaagcgtcatccttgaagcggcgcagggattccagctcgccttcgaagataacgatgtcttcacgcagtacacggattggacggttacggtgaacgacaccctcgatcaccatgcaaccggcgatcgcgccgaacttcggcgaacggaacacgtcacgaacctcggcaacacccaggatgttctcccgaacgtcgctgcccagcataccggtcagggctttcttgacgtcttcgatgatgtcgtagatcacgttgtaataacgcatatccagaccttcctgctcgacgatcttgcgagcgccggcatcggcacgcacgttgaagccgaacaggacagcgttggaagccagggccaggttggcgtcgctttcggtgataccaccaacgccgccgccgactacgcgcacttgcacttcgtcgttgcccaggccgttcagagcgccttgcagggcttccagcgaaccacggacgtcggatttgaggacgatgttgagcgtcttcttctcttcctggcccatgctttcgaagatgttttccagtttgccggcgtgagcgcgagccagtttgacttcgcggaacttgccttgacggaacagagccacttcacgggctttcttctcgtcggcaaccacgctcatctcgtcgccagcgtccggggtaccgtccaggccgaggatctcgaccggaatggccggacctgcttccttgatcggcttgccgttctcgtcgagcatggcgcgcacgcggccatagttcgagccgaccagcaccatgtcgccttgacgcagggtaccgtcctgaaccagtacggtcgccaccgggccacggcccttgtcgagacgcgattcaaccacgacaccacggccaggagccgaaggagtggcggtcagttcgagcacttcggcctgcagcagtacggcttcgagcaattcgtcgacgccggtacccatcttcgcggaaaccggaacgaatggagtatcgccaccccagtcttcggaagtcacgccgtgaaccgacagttcgctacggatgcgatcgaggtcggcacccggcttgtcgatcttgttcaccgcgaccaccagaggtacgccagccgcctgagcgtgctgaacggcttcaacggtctgtggcatcacgccgtcgtccgctgcaaccaccaggatcacgatgtcggtcgccttggcaccacgagcacgcatggcggtaaacgcggcgtgacccggggtatcgaggaaggtgaccatgccgcgttcggtttcaacgtggtacgcaccgatgtgctgggtgatgccgccggcttcgccagccgctaccttggcacgacggatatagtcgagcagcgaggtcttaccatggtcaacgtgacccattacggtcacgactggcgcacgaggaaccgcttcaccttcgaacttcagggactcggccagggaatcttccagggcggtgtcgctgatcagggtcactttgtggcccagttcttcagcaaccagctgggcagtttcctggtccagtacctggttgatggtggccggtgtgcccagcttgaacatgaacttgatgatttcggcagccttgaccgacatctgctgggcgagatcgccaacagtgatggtttcgccgatcttcacttcacgcacgaccgggccggttgggctctggaaaccgtgagcgttgcgtttcttcagcttggccttgccgcgaccaccacgacggaagccatcgctttcttcgtcggtggtacgtggggcaacgcgtggagccggagccttttccttgacggaagcacgatgcggagcgtttttacgctcgccatcgccaccacgacggttgtcgtcgttacggctcttgtccgggcgacgctgctcgtctttcttgcgcacttccgcgaccggcgctggagcgacaacagggacatcttcaacaatcggctcggcaaccaccgcaggtgcggcaaccgcttcaacggcagcaggttgcgcagcagcaggctggcgacgcgcttcttcttcggcgcgacgcttggcttcttcttcagccttctgacgtgcagcattttctactgcgcgacgttcttccagttcacgctggcgctcggcttcgatttcttccgggctgcgctgtacgaagactttcttcttgcgtacttcaacgctgatgcttttgctgccggccacacgcagggtgctggtggttttacgctgcaacgtgatcttgcgcggttcttccactttcgccttgtggctgctcttcaagtgagtcagcaacgattgcttctcactgtcagtcacatgttcctcggcggcggtgtgcggcagacctgcctcacgcatctgctgcaacaggcgctctaccggtgttttgacctcatcggccagttgtttcaccgtgacttgcgtcatgcacttctctcctcaggccgcgcctattactcgaaccaatgggctcgggcggccatgatcaacttgccggcacgatcatcgtcaatgccgtcgatgtcgagcaggtcgtcaatagactgctcggccaggtcttcgcgggtaattacgccgcgcaccgccagttccatcgccaaatccttgtccataccctcaagcgagagcaggtcttcggccggatgggcgtctgccagcttttcctcagtagcgatggctttagtcaacaagcgatccttggcacgagcgcgaagctcgttgacgatgtcttcgtcaaagccgtcgatgttgagcatttcttccaacggtacgtaggcaatctcttccaggctggtgaagccttcatcaaccagcacctgtgccagctcttcgtcgacttccagctcgtcgatgaagttgcgcaggatgtcgccggtttcagcttgctgcttagcctggatgtccgattcggtcatcacgttcagggtccagccagtcaactggctggccagacgcacgttctgaccaccgcgaccgatggcctgagccagattgtctgcgccaacggcgatgtccatggcatgggcatcttcgtcgacgataattgccgcgacttcagccggcgacatggcgttgatcacgaactgcgccgggttgtcgtcccacaggacgatatccacacgctcaccgcccaactcaccggaaacggcctggacgcgcgaaccgcgcatgccaatgcacgcaccctgagggtcaatgcgcttgtctttggaacggaccgcaatcttggcgcgcgaacccggatcacgggaggcagccatgacttcgatcaggccttcggcgatttccggcacttcgatacggaacagctcgatcagcatttccggcgcggtgcgcgacaggatcagctgcgggccgcggttctcggtgcggatttccttgagcagcgcacgaagacgcacgccaacacggaaagtctcgcgggaaatgatgtcttcgcgggccaacagcgcttcagcgttgttacccaggtcgacgatcacattgtcgcgggtcacttttttcacggtgccggagatgatttcacccaagcgctcgcggtaagcgtcaacgacttgagcacgctcggcttcgcggactttctgcacgatgacctgtttggcggtctgcgcagcaatgcggccgaattcgatcgactcgatcttttcctcgacgacatcaccgactttcgcgcccggatgggtttcctggaccttgctcggccaggtttccacagccggatcgtccagatcggcttcctcgactaccgtccagcgacggaaagtctcgtaagcaccggtgtggcgattgatttccacacgcagatcaacttcgtcctcgaaacgctttttggtagcagtggccagagccagctccagcgcttcaaaaattacgcttgccggtacacccttttcattggataccgactcaacaaccagcagtacttctttgctcatcgtacgcctcgcctttcgcaagccattggatccgcgggatccgcgtctcagtcaaaactgggaattatgtgggccttgtcgatcatgtcgatcggcaacaggaattcgtggtcttccacctgcaccacgacgtcctgctcctccaccccgcggagaaggccctgaaaattacgccggccttcaaaaggcgagcgcagcttgatcttcacttgttcaccgacatacttggcaaactgttcaagggtgaacagcgggcgttccatgccaggagaggaaacttcaagggtgtattcaacagagatcggatcttcgacatccagaacgccgctgatctgacggctgacgatggcgcagtcgtccaccagcacaccgccttctttatcgatataaacgcgcaacagtgagtggcgaccttgagccgaaaactcgataccccagcattcatagccaagggccacgaccaccggggccaacaaggcctgcaactgttctagcttgctcgacacctgaaccccctcgtgcatgcttgtgcaaataaaaaatgggcgaagcgcccatcccggaaacgccgttgaatagcggcgttataaagtgtccagctaacaaaaagcccctaaaaaggggctccgctaaaactggttgcgggggccggatttgaaccgacgaccttcgggttatgagcccgacgagctaccagactgctccaccccgcgacaaagctggggcggaagtatacgaccgatccctttttgggtcaatgtaaccttccacctacaagaaagcccgcaacagcgggctctcctgataattggtaccgagaaggggactcgaacccctacaccctatgggcacaaccacctcaaggttgcgtgtctaccaattccaccacctcggcatagactacgttactgcgtgaaactcttcttacttctgctcttgagctggaggtacgtcagtcgcattggttgccgacttttgctcttggagcaccgggacatcatcagaagccggtttttgctttggcgcttcaagcaccgctggatctggcaaacctacttgagtcagctcatgagctttctctttagcaaagtaacctaaccctaagctggttatgaaaaaacctgcggcaagtatagcagtaaacttactaagaaaggtagaggaaccttggcttccgaacacagtatttgaagcacctgctccgaaagacgcgccagcgtccgcacctttaccctgctgcagcaataccagagctactacgcccagcgcacccagcagatgaaaaacgactacgactgtttccagcattttttcagtttcccgcggcgcgacaaatcgcaccgaactcatctgcattcagggaagctccaccaatgagccccccatcgatatccggcatgccgaacagttcgaccgcattggccgccttcacgctgccgccgtatagaagccgcacacctcgtgccacttcagaattctctgccgccaactgcgcccgaatggctgcgtgcacatcctgggcctgttgcggcgaagcagtcagcccggtaccaatggcccagaccggctcgtaagcaataacggcattggcaaatgcaccaacacccaactcttcgataatgctgcccagctgacgcccgacaacttcaagagtcttcccggcctcgcgctgctcgagggtttcccctacacacaagaccggcttcaagccacaagcctgtgctgctgcgaatttgcgattcagcgtaccgtcacgctcacccatcatcaggcgacgctcggaatgcccgaccaacaccagggaacaacctgcatccaccagctgactcggagcaatctctcctgtcagcgcaccttgcatgggctccaccgcagagttctgcgcgccgaccgaaatcgacttgcctttcaagccatcaatcacctgattgatatacaagcaaggcgggaataccgcgacatcaacaccgctaggcaaggccagatgacgcaggccattgatcagctcagcgacgctggcgcgggtaccgtgcattttccagttaccagctaccatagggcgacgcatgctgtacctcgtcggtcaaagtgggcgcagatgttacccaaccgcatcaacactggcaagccgaaatcaggcagaaacttccgcaaccagttttgccagttcgtcagcatagccacggacctgggtttcatcatcgccctcgaccatgacgcgaaccaaaggctcggtgcccgacttgcgcagcaacacccgcccacgcccagccatcgcggtagtgacgcgcgcgcaggcctctttcacagccggatgctcgacaggattggcaccaccgccaaaacggacattgaccagaatctgcggacatttgcgcagcgcctggcgcgactgtgccaaaccttcatcacgccgtttcagtgccatcagcacctgcagagcggcaatgatcgcatcacccgtagtggtgtgctggaagcacacgatatggccggagttttcaccgcctaccagccattggcgctcaagcagctcggcaatgacataacggtcaccgacattggcgcgcacgaatggaatacccagatcagccaaggccagctcgagccccagattgctcatcaaggtaccgaccacacctccctgcagcttgttacgcgcgtgcaggtcccgagcaatgatgaacagaagttcgtcgccgtcgacgatggcgcctgtatggtcgaccatcaacacccggtcgccatcaccatcgaaggcgatacccagatcggcgtgctcggccaataccgcagcctgtaactgccccatgtgggtcgagccgcaattgtcgttgatgttcagaccgttaggctgtgcggagagcaccaccacttcagcgcccaactcacgaaaaacacttggcgcgaccttgtaggtcgcaccgtgggcacaatcgacaacaatcttcagacccgcaaagctggtgctggaaggaacgctgctcttacagaattcaatgtaacggcccgaggcgtcattgatgcgcgataccttacccagcttgctcgactccaccactgtcatcggcgcatccagcaactcttcgatcatcagctcgacttcatccgggagcttggtaccttcacccgagaaaaacttgatgccgttgtcatcgtgaggattatgcgacgcactgatcacaatccccgcctcagcatggaaagtacgggtcaggtaggcaatggcaggagtaggcatcggacccagcagcattacatccgcaccggcagcggacaggcccgcctcaagcgcggactcgaacatgtaaccggaaatgcgcgtatctttgcccaccaacacacgacaggcgcccatactgcgaaaggccatacccgcagcccagcccagcttgagcatgaaatcgggagtaatagggtacacgcccacacgaccgcgaatgccgtcggtgccaaagtatttcttgctcataagtgctccatcattcttattcggctgattccacagctgtaatcatccgcacgacatccaccgtctcggccacatcatggacccgcaggagctttgcccctttggacattgccagagcggcaagagccagcccgccatacagccgctcgccgacggggcgactcaatgcctgacctatcatgctctttcgtgaaactccgaccagcagaggtcgaccaagggcatgcagggcgtccatatgcttgaacaggctcaagttgtgctgcagggtctttgcgaagccaaagcccggatccagaatgatccgttccgacccgatacccactgcagcacactgagccatacggtcagccaggaattgccccacttccttggttacatcccgatactgcggattgtcttgcatatcgccaggctcaccgagcatatgcataagacagaccggtaaacctgtggccgctgcagcatccagcgcgccatcccgccgcaacgagcggacatcattgatcaatcccgcgcccaggcgcgcagtttcgcgcatgactgcaggcgtggatgtatcgaccgaaataatgacatccagttcacgatggatgcgttcgacgataggtgctacccgctcaagctcttcaagcggcgataccgcccgcgcaccaggacgagtggactcgccccccacatcgatgagcgtcgcgcccgccagcaccataccttcggcatggcgcaaggcagcatcaagctgactaaaacggccaccatcggagaaggagtcgggagttacattaagaatgcccatgacatgcgtatgggccaaatcaagaacccggttgccgcaaggcaaccgggtcgaggacgacatagaagtcatttcaaaccttagtggtcagcagccgggccgccgatcggtgtctctggacgttcgttctgcaccaccggaggtgtggtacccgagccgccctcccaatcgcgaggctcgcgaggggtacgaccagccatgatgtcgtcgatctgctcggcatcgatggtttcatacttcatcaaggcatcggccatcgcatccagcttgtcgcggttatccgtgaggatttgcttggcagtgccatagcactggtcgatgatgctacgaacttcggagtcaatcagcttggcggtttccgcagacaggcttgcatgctggctgccagcactgcgccccagaaagacctcgccctcttcttcggcgtacatcaacggacccagtttttcggaaagcccccacttggtcaccatgttccgcgcaatctgactggcgcgcatgatgtcgttggaagctccggtagttacaccgtcaaagcccaacgtcatttcttccgcgatacgaccgccgtagagcgagcagatctgactgatcagcgcacgcttggacaagctatagcgatcctcttccggcaggaacatggttacacccagagcccgaccacgcgggatgatcgaaaccttgtagaccggatcatgctcaggcactacgcgaccgacgatagcgtgacccgcttcgtgataagccgtgttctgcttttccttctcggacatgaccatggatttgcgctccgcgcccatcatgatcttgtcttttgccagttcgaactctttcatctcgacgatgcgcttgccactacgggcagcgaagagcgacgcttcgttcaccaggttggccaggtcggcaccagagaagccgggcgtaccgcgggcaatcactgccggggcgacatcttcccccataggcactttacgcatgtgaactttcaaaatctgctcacggccacggatatctggcagaccgaccacgacctggcggtcgaaacgacctggacgcagcagcgccgggtccagcacatcaggacggttggtggcggcaataacaatgatgccgtcgttcatttcaaagccatccatctctaccagcagctggttgagagtctgctcgcgctcatcatgaccaccacccatgccggcaccacgatggcgaccaacggcatcgatctcgtcgatgaagatgatgcaaggggcatgtttcttggcctgttcgaacatatcgcgaacacggctggcacccacaccaacgaacatttcgacgaagtcggaaccggaaatggtaaagaacggaaccttggcttcaccggcgatggccttggccagcaaggtcttaccggtacccggcgggccaaccatcagcacgccgcgaggaatacgaccgcccaggcgctggaatttgcccggatcgcggagaaactcaaccagttcacccacttcttccttggcctcgtcgcaacccgcgacatccgccaatgtggttttcacttgatcttcggacaacaggcgcgccttgctcttaccgaagctcatcggcccgcccttgccaccagcaccaccctgcatctgccgcatgaagaacatgaagacggcgatgatcaccaggatcgggaagctggcgaccagcagttgggtccagatgctttgctgctcaggctgcttgccttcgacgaccacgtggttatccaccaggtcaccgatcaggccgttgtcctgaatcgcaggacgaatggtcttgaagctatcgccatcgttgcgcttgccggtaatcacataaccatcaacggctacgcgctcgaccttgccatccttaacttgctggataaagtcggaatagttgagggtctgcggctcgttagggctggagaagttgttcatcaccgtcaccaggacagccgcgatgatcaaccacaggatcagattctttgccatatcgttcaattaactaccctctgaagcaagctccgctgctggcgcgcgcttcgcatgatattcaccgacctaacttactacattacctacagctctggcaggcgctgtctgtaaccctttgtgaaacccagattacacaatattcgcttaagcccccggggcgaaatacgaaaaaactatcaacccggtcaaaaacaacctttactcgatacgcccgcgaaagccacgtcccagcagatactgctcgcgagaacgatcacgggaagaactcggtttgcgcatcaccaccttgtcgaacatcttgcgaacgttcttgtggtattcgtcgaaaccttctccctggaaaatctttatcaggaagtcgccaccgggacgtagaacccgccccgccaaatcaagtgccaactcgcacagaaacatcgcccgcggcatatctacggcaggcgtaccactcatattgggggccatatcggaaatcacaaggtccacctgggaatttccgactgcctcgaggatttgagccaacactgcatcttcggtgaagtcgccctgaatgaaggtgacatcagggatgctatccatttccagaatgtcggaagcgatcagtcgcccctgcccgccgatcagacgactggtcacctgcgaccagccccctggtgccgcgcccagatcgataacactcattccaggacggatcaggcgatccttttcctggatttccagcagcttgtagctggcacgcgaacggtacccatctttttgcgccattttgacgaatgggtcgttgaagtgctctttcagccagttatggcttgtcttggaacgggccacgggccacctcaaaaaataaaacgggtcgtgattaactgggcggtcccggacgcgctcgggtaaactggccgccgctttttacaagatcagacgcaggggtcagattatgccgctcactcaagagcagaagaaacagtacaaatccattggccaccatctgaaaccagtattgactgtggctgacaacggtttgaccgaaggtgtgttggccgaacttgaacgcgccttgagcgatcatgagctgatcaagatcaagctcaacatcctcgaacgcgagtcccgcctggaagccattgccgaactgtgcaaggccggcaaagcggatctggtgcaggtcatcggcaaaatggcgttgatttatcgcaagaacgccaaggtaaacaagcaactgtccaacgtccatcgcttccactgacgtcgacaggggtcaagggcgcgcttcgcgcgccctgccactccacccaggcaccggctgcaataccagcaccagaccggaaaaagccaagacaagatagctgaacaactgccagcgctcgacatccgacagcccgaagcgcaccacgaaatacatcgtgcacgcacataacgccaccaacaacagctgccctcgcatatcccgccacaggctcgccagcccttcagcacgtaccaataccagcatctgaagaacgatgcataccgctgaaaaaccaaccaacagcgcactcagcacattaccaatctcttcgatcagcagcggcgccaggccaatctggcccagcaccggcaacaagccgacatgcaacaaccacacaccaccgacccacaacatctgagtcagttgccaaagcatggcgcctgcattcagcaggcgccctcgttcagatgtggcggacttcgacaatctcgtactcgatcacgccgctaggcgttttaacggcaaccacatcaccctcttccttggcgatcaaggcacgggcaatgggcgagcctacagagatctttccgagcttgatgtcagcttcatcctcaccaacgatctggtaagtgacgctctcatcggtttcaacgttggcgatttcgacggtagtgccgaaaatcaccttgcctgtatgaggaatgctcgtcacatcgatgacaaccgagttttgcaggcgaccttcaatatcccggatgcgcgcttcaaccattccctgctcctcgcgggcagcatggtattccgcgttttccttgaggtcaccgagttctcgggcctcaccgatggcctggctcaagcgtggccgttcgaccttgctgaggaacgtcaactcttcttccagggccttggagccctggacggtcattgggtatttattcatgccttcaatcctgcatgtagatcctgcaagcggcgcacggtcttttccggaccgaacttgagcgcttcacagatggcctcgcccgcagcaatggtggtggtgcagtagatcttgtgctgcaaggcgttacgacgaatggaataagagtcagcgatcgactgacgaccttcggtggtgttaatgatcagcgtgacttcgtcattcttgatcatgtcgaccacgtgcggacgaccttcagtcaccttgttcacgcggcgcaccttcaggcctgccgcctcgatcagcttggcagtaccggcagtggcgaccacttcgaagcccaagttgatcagatcacgagccacgcccgcaaccagcggcttgtcgtcgtcacgcacgctgatgaacgcggtaccaccagtcggcagcacttcgctagcgcccatctgggccttggcgaaggcttcaccgaaggtgtcaccgacacccatcacttcgccggtcgacttcatctctgggccgaggatcgggtcgacacccgggaatttggcgaacgggaacaccgcttccttgacactgtagaagttaggaatgatttccttggtgaaacccagctctttcagggtcttacccgccatgacgcgcgcggcgatcatcgccagggagacaccgatgcacttggaaacgaacggcacggtgcgggaagcacgcggattcacttcgatgacgtagatctgctcgccctgcagggccagctgcacgttcatcaggccgaccacgcccagctccagggccatcttcttgacctgttcgcgcatctcgtcctggatgtgcgcaggcagcgagtacggcggcagcgagcaagcggagtcaccggagtgcacgccagcctgttcgatgtgctgcatgatcgcgccgatcaccacatccttgccgtcgcagaccgcatccacgtccatctcgatggcgcagttgaggaagtggtccagcagcaccggactgtcgttggacacttgcaccgcttcacgcaggtagcgcttgagctcttcttcttcgtaaacgatttccatcgcccggccgcccagtacataggacggacgcaccactagcgggtagccgatcttggccgcggcacgaatcgcttcgtcttcgctgcgcacggtggcgtttggcggctgacgcaggttcaggcgctcgaccatctgttggaagcgttcgcggtcttcggcacggtcgatggcatcagggctggtaccgatgatcggcacgccggccgcttccagggcacgcgccagtttcagcggagtctggccgccgtactggacaatcacgccttttggcttctcgacgcggacgatttccagtacgtcttccagggtcactggctcgaagtacaggcgatcggaggtgtcgtagtcagtggaaacggtttccgggttgcagttgaccatgatggtttcgtaaccatcgtcacgcagcgccaatgcggcgtgcacgcagcagtagtcgaactcgataccctggccgatacggttcggaccgccacccaggatcatgatcttgtcgcgacccgaaggtgccgcctcgcactcttcctcgtaggtcgagtacaggtaggcggtatcggtggcgaactcggccgcgcaggtgtcgacgcgcttgtagaccgggaacacctccagcttgtggcgatgagtgcgcaggttcttctcggtcacgcccagcaacttggccagacgctggtcggagaagcctttgcgcttgaggcggaacatcaggtcgcggtcgatggccgacagccccagtgtcttgaccttctcttcttccttgatcaggtcttcgatctgcaccaggaaccaaggatcgatcatgttcatgccgaagatctgctcgacggtcatgccggcacggaaggcatcagccacgtaccagatacgctcggcacccggcacggtcagctcgcgcttgagcacgttcatgctttccgggttgctcaggtcgagcttcggatccagaccgcagacacccacttccaggccacgcagcgctttctgcagggattcctggaaggtccggccgatggccatcacttcacccaccgacttcatctgagtggtcaggcgggcatcggccttggcgaatttctcgaaggcgaagcgtggcagcttggtcacgacgtagtcgatggacggctcgaaggacgccggggtcttgccgccggtgatgtcgttcgacagttcatccagggtgtaacccacggccagcttggcggcgaccttggcaatcgggaagccggtggctttcgaagccagggccgaagaacgggatacccgcgggttcatctcgatcaccaccatacggccagtgttcgggcagatgccgaactggacgttggagccaccggtttccacgccgatctcacgcagtaccgccagggaggcgttgcgcaggatctggtattccttgtcggtcagggtttgcgcaggagccacggtgatcgagtcaccggtgtgcacgcccatcgggtcgaagttttcgatcgagcaaacgatgatgcagttgtccttcttatcgcggaccacctccatctcgtattctttccagccgatcagcgattcgtcgatcagcagttccttggtcggcgacaggtccaggcctcgggcgcagatttcttcgaactcttcacggttgtaggcgataccgccaccggtgccgcccatggtgaaggacgggcggatgatgcacgggaagcccagcttctcgaggaccgcattggcctcgtccatgctgtgggcgataccggagcgcgggcactccaggccgatcgccttcatcgcggtgtcgaagcgcgaacggtcttcggccttgtcgatggtgtcggcattggcgccgatcatttccacgccgaacttctccagaacgccttcacgctccaggtccagggcgcagttcaacgcagtctggccacccatagtcggcagcagagcgtccggacgctctttctcgatgatcttggcaacagtctgccacttgatcggctcgatgtaggtggcgtcggccatggccgggtcggtcatgatggtcgccgggttggagttcaccagaatgacccggtaaccctcttcgcgcagggccttgcaggcctgggcgccggagtagtcgaattcgcaagcctggccgatcacgatcgggccagcgccgagaatcaggatgcttttaatgtctgtacgttttggcatgggttgtcactcaaatccgcaggtcagtcggcaagccgtcttgatcaaatctctgaagcgctgaaggggccaccgatgccggggccaccttcaggggcgagcactcagcgtcgcttggccatctcgttgatgaaacgatcgaacagcggcgccacatcgttcgggcccgggctcgcttcagggtggccctggaagctgaatgcgctcttgtcggtacgttcgatgccttgcagggtgccgtcgaacagcgatttgtggatcgcccgcacgttgcctggcagggtggcttcgtccaccgcaaaaccgtggttctggctggtgatcatcactacaccgctgtccaggtcctggaccgggtggttggcaccgtggtggccgtggcccatcttcaccgtcttggcgccggaggccagtgccagcagttggtggcccaggcagataccgaagaccgggatctcggtttccagcacatccttgatcgcctggatggcgtaatcgcaaggctcggggtcgccagggccgttggacaggaacacaccgtcaggcttgagtgccaggacgtcgctggccgaagtttgcgcaggcactacggtcacgcggcaaccgcgctcgaccagcatgcgcaggatgttcagcttgacgccgtagtcgtaggcgaccacgtggtacggcagctcggaagcctcgatagtcggatgactgtcggtcttcaggctccagacgctggagcgccactcgtagctttccttggtgctgacgaccttcgccaaatccatgcctttcaggccagggaagccgcgcgctgcggcaatcgccgcttcgtcggaaatgttgtcgccggctatgatgcagccgttctgcgcgcctttctcgcgcaggatgcgcgtcaggcgacgggtgtcgataccggcgatcgccacaacgttgttggctttcaggtaatcggacagggacagggtgttacgccagttgctcgcaaccagtggcaggtcgcgaatcaccagaccggccgaccagacacgatcggactcggcgtcttccggcgtggtgccggtattgccgatatgcgggtaagtcagggtaacgatctgttgggcgtaggaaggatcggtaaggatttcctgatagccggtcattgcggtgttaaacaccacctcaccaacggtttgaccgtcggctccaatggcttcgccgcgaaaaatgctgccatcagcaagggcgagtatggctggcttagtcaagaagacctcccgtaaataaagcctgaaagggcgatcgcaggttgtaaaaaagcggagtgacgtatggacacgtcaccccgcttcttcaccgaattattctgcgcgcttttagtggacacactaaagctgtagcttacagaaaaaggcttttttggtccaccgctaaagagccttaaaggcagaggaatgcgacagaacatcgcttagcgggttaaaacagggctcaagcgcgaagcctagccctgttttggatgcatctcaacgcagatccagcacatcctgcatgtcataaagacccgccggacgaccgtccagccacaacgcagcacgtaccgcacccttggcgaaagtcatgcgactggaagccttgtgggtaatctccagacgctcgccctcagcagcgaacagcaccgtgtgatcgcccaccacatcaccaccccggaccgtggcgaaaccaatggtctcacgctcacgagcccccatatggccttcacggccatacaccgcgaccttctgcagatcacgccccagcgcatcggcaatcacctcgcccatgcgcaaggccgtccccgaaggcgcgtcgatcttgtgccggtgatgcgcctcgatgatttcgatgtctgcatcatcgcccagcacacgggctgccatgtcgagcagcttcagcgacagattgacgccaacgctgaagttggcggcgaacacgatcggaatatccttgccggcctcggccagcatctgcttttccttggctcccagccccgtggtaccgatcaccatggccttgcccgccttgcgacagaatgccaggttcttcagcatcacttccggcagcgtgaaatcgatcaacacatcgaattcatcggcgaccttttccaggctgtcggacattggcacaccaatgcgccccagcgatgccagctcgccagcatcggcaccaaccaacgaactgccaggccgcacgatcgccgcggtaagcccggagagcggcgagcgctgttgcacggcctccaccaggttcttacccatgcgccctgcggcgcccatcacagctatacgtcgcatgcttcgctccttacaggtcgccgaagaagcgcttcacgccttcgaaccagccagtggttttcggcgagtgggtattgtcgtccgccagggaaccacgcaactcttcgagcaattcacgctgacgacgactcaagttcaccggcgtttccaccgcaacccggcacatcaagtcgccagcaccgccgccacgcaccggagccacacccttgccacgcacacggaactgcttgccggtctgggtgccctcaggaatcttcagtttgacccggccatccagcgtcggaatttccagctcgccgcccagcgccgcatcaacgaagctgataggcacttcacagaacaggtgcttgccgtcgcgctggaagatcgcgtgctcacgcacattgatcaccacatacaggtcgcccgtagggccgccctgggtacccgcctccccttcgccggacagacgaatgcggtcgccggtatcgacacccgccggcactttcaccgacagcgtcttgtactcttcgacgcggccttcgccgtggcaggagtcgcacgggtcggaaatgatcttgccctggccatggcaacgcgggcaggtctgctgcaccgagaagaagccctgctgcatgcgcacctggccaataccgccacaggtcggacaggtaacaggcgaggagcctttcttggcgcccgagccgtcgcaaggcttgcagttgaccagcgtcggaacacggatattcacggtggtgccgcgcaccgcctcttccaggttcagctccagggtgtagcgcaagtcgctgccacgctgagccccgccacgggagccgccacgaccaccaccaaagaaatcactgaagacatcgccaaagatgtcggagaaattctggccaccgaagccggcaccaccaccgcccatgctcggatcgacaccggcatgaccatattggtcataagccgcgcgcttgctcgagtcagacaatacttcgtaggcctcgttggcctccttgaacatatcttccgacgctttgtcgccgggattacggtccgggtggtgcttcatcgccaggcggcggtaagcctttttcaggtcggcttcactcgagcctcgctccacacccaatacttcgtaatagtcacgctttgccataagtcttcacactcttgaggacgttcgacaatgctctcctgagcctcgccaaactcgttgagccccaatacaggcccggacccaactcacgtcaattcaacgatcctggtcttggatagacgaccaacagactggccgacaactgcggcaatcccgaacggaaagcaggagcatttccgaccgtaccgccagtgcgcgaaaagagtcgcacaccgtaaaaaattcgcttgctccagacacgccaacgcgggagcaagctcccgcgcggcgacatcctaccagtcaccgcacaaaggcagtcaaccggccgaccaacaagcagtcttacttgtggtcttttacttcttcgaactcggcgtcgacgacgtcgtcggctttctcggccgactcggcctgcgaagctgcgccttctgccggctgagcctgctcggcgtacatcttctgagcgaccggagccgacaccttcgacagctcttcgaccttggcgtcgatggcagccttgtcgtcgcctttgatagcggcttcaagggcaaccacggcagcttcgatcgcagccttctcttcagcagtcactttgtcgcccgcatcagcgatcatcttgcgagtcgagtgaaccagggcatcgccttggttacgcgcgctggccagctcttcgaacttgcggtcttcttcggcgttgacttcagcatcacgaaccatctgctgaatttcttcctcggacagaccggagttggccttgatcacgatcgactgggtcttgccggtcgccttgtctttcgcacctacgtgcaggatgccgttggcgtcgatgtcgaaggtcacttcgatttgcggcacgccacgtggagctggtggaatctcggccaggtcgaacttgcccagggatttgttctgcgcggcttgcttacgctcgccctgcagcacgtgaatggtcactgcgccctggttgtcgtcggcagtcgagaacacttgcgatttcttggtaggaatcgtggtgtttttctcgatcagcgcggtcatcacgccgcccatggtttcgatacccagggtcagcgggctgacgtccagcagcaatacgtctttcacgtcaccagccagtaccgcgccctgaatggcagcacccatggcaacggcttcgtccgggttcacgtccttgcgtgcttctttaccgaagaaatcggtcaccagcttctgcaccagcggcatgcgggtctgaccgccgaccaggatcacgtcgtcgatcttgctgacgtcgataccggcgtccttcatggcgatgcggcaaggctcgatggtgcgctgaaccaggtcttcaaccagcgattccagcttggcgcgggagatcttcacgttcaggtgcttaggaccggtggcgtctgcggtgatgtacggcaggttgacgtcggtctgctggctcgaggacagctcgatcttggctttttcagcggcttctttcaggcgctgcatggccagcgggtcacccttgaggttcatgccgctttctttcttgaactcgtccacgaggtagtcgatcagacggatgtcgaagtcttcaccaccgaggaaggtgtcaccgttggttgccagtacttcgaactggtgctcgccatcgacttcagcgatttcgatcacggatacgtcgaaggtaccgccacccaggtcataaacgatcacggtgtgatcgcccttggccttgtccatgccgtaagccagagcggccgcggtgggttcgttgatgatacgttttacgtccaggcccgcgatgcggccggcgtctttggtcgcctggcgctgactgtcgttgaagtaggccggaacggtgatcaccgcttcggtcacagcctcgccgaggtagtcttcggcggtcttcttcattttcttgaggatttcagccgagatctgtggcggagccattttctggccgttcacttcaacccaggcgtcattgttctcagccttgacgatcttgtaagggaccatctggatgtctttctgtacgacttcttcgtcgaaacggcgaccaatcagacgcttcaccgcgtacagggtgttgtgcgggttggtcacggcctgacgcttggccgactggccaaccaggatttcgccatcgttggcgtaagcgatgatggacggcgtggtacgcgcgccttcagcgttttcgataacttttacgttgccgttttcaagaatggagacgcaggagttggtagtccccaggtcgataccgataattttgcccatgttaactctcccgaaactttagattttgttgccgcagcagtggtggtggccgactgcggtagcacttaaacgcttgacctataaatgggggccctactcgcgatttcaagccttctcgtcaatcgaaggcgaaaccggtgcgggtgccttgctgaccacgaccatggccgggcgcagcaggcgaccgttgagctgatagcccttctggaacaccttgagaacgctgttcggctcgacgtcggcactttcctgcatggccatcgcctggtgctgttcagcgttgaacggttcgccatgcggatcgatcgcttccaactgataacgcttcagggtgtcctggaacatcttcagggtcagttcgataccttcacgcatcgggcgaatgctttcgtcgtccgggctggacaactcaagaccgcgctcgagactgtcgatcaccggcagcaggtcgccagcaaaacgctcgagggcgaatttgtgagctttttctacatcctgctcggcacggcggcggacgttctgcagatcggccgcaacacgcaatgcctgatcctgagcgccagccaactgctcttcgagcacttgcacacgagccgccagatcttcgcccgaagtctcgggggcctgattggcgtcgagattttgcgtatccagcgtctgttcgtcagccataaaattctcctttcaatatcgtccgcgagctcaactcacgcttctgccccgatatatggggtcgcattttccaggttcaagggccgtgccctcggcaaaaatcattggacgcccccaaacgccggtcgctaactattcccgcacacgataaaaaaatccgccaagcaagcgaatcgagctaagggcgggcattgtcagccgaaaacaaaacactgtataaataaccagacctaaagcttgggagcggcctttatgctggtgcacctgtccgtacacaactacgccatcgttgaacatctcgatctggaactggatcgcgggatgagcgtcatcacgggtgaaaccggcgccggcaaatcgatcatgctcgacgccctggggctgaccctgggtgatcgcgccgacagtggcgtagtacgcccaggtgccgacaaggccgacattctcgccaccttcgacctggaagacattcccgaggcccgcacctggctcgccgaacgcgacctggacaacgacagcccatgcatcctgcgccgggtcatcaccgccgaaggccgttcccgcggctacatcaatggctccccgtgcccgctaggcgacctcaaggccctcggcgaactgctgatcgacatccacagccagcatgaacaccagtcgctgctgaaaaccgatacccaccgccgcctgctcgacgaatacgccggtgccaccgacttggctcgccaggtatcgctggcagcccagcgctggcgccaaacccgccaggaactggagcgcctgtccaactccggggacgagcagcgggcgcgccaccagctcctcagctatcagctggaggaactggagaacctggccctgggcgaaagcgaactcgagcaactggaactcgaacacaagaacctgaccaatgccgaaagcctgctgggcatctgccggcaggtcgtcgagcattgcagcgaaagtgattcgggcaacgtcctcagcgccctgacagcgagcctcaatcgcctgtcgagcatcggcaacacctccggcgccctggcggaagccaccaacctgctggccagcgcgcaaatccaggtcgaagaagccgtcggcgaactgaatcgcttcgtcgaccatttcgatgcggacccggcgcgcctgcaacaactggaggagcggttggacgccatctataccctggcccgcaaacaccggatccagcccaccgaggtggcagccatgcagcagaaactgctggaggaaatcgaaactctggatgccaatgacgaatccattgagcgcctgggcgatgagctgaaatcctttgcccggcactatcacgaaaaagccagggagttgagcgagctgcgccagcaggccgcaaccagcctggccagcgccgtcgaacaggaaatccagcgcctgggcatgcctggcggccgcttcaccatcgaactgcacgccaacagcggcgatgaactacagcccaacggcctcgagcaggtcgagctgttggtcagcgccaaccccggccagccgctcaaggccctggccaaagtggcatccgggggcgaactgtcgcggatcagcctggcaatccaggtgattaccgcacagacctctcgtgtcccgaccctggtattcgacgaagtggacgtcggcatcggcggcccgaccgcggagatcgtcggccaactgctacgtcgcctcggcgagcgcggccaggtattgacggtcacccacttgccgcaggtggcagcccagggccatcaacatctttttgtgcacaaggtgcgcggcagcgatgcgactcacaccgcggtttccaaactgggcaagaccgagcgaatcgaagaggtagcgcggatgctgggcggcatcgacctgaccaaggagtcgctggcccacgcgaaaaaaatggtggttaccgccaaggcttgagtccctgccactttaataaagagcagaaagcacgaaggcgacccttgggtcgccttcgatcgtttcgcggactatgtccgcgcgacatgcttatttcttcgtgcgtacgtacagcaccaagttgtgatccaccaactcgaagccatgcttctcgacaatcgccttctgaagcttctcgatttcttcgtcgaagaattcgatcacctcaccggaatccacgttgaccatgtggtcgtggtgaccgccgtcagccagttcgaatacagcatgaccgccatcaaagttgtggcgcaccacaaggcctgctgcttcaaactgggtcagaacacggtaaaccgtggccagaccgacatcctcgccagcttccatcagcgccttgtaaacatcctcggcactcatgtgtcgctgctcggcggaatcgagcatttgtagaattttgacccgtggcagagtcactttaaggccggctttacgtagttcgctattttcaaccatggtcagctttctcgcggatgctgcttcgcagctcctcttaatgcgggtatgatcggggtttacgttgtcccagccaagatagtggaagtcgcccaccgatgcaaaacaccaagctcttgctaaccagtttcaccttcgtgggactgctcgcactcgccggttgttcattccccggggtttacaaaatcgacatccagcagggcaatgtcgtcacgcaggacatgatagaccagttacgcccgggaatgacccgccggcaagtacggtttatcatgggcaaccctctgttgaccgacacgttccacgccgatcgctgggattatctgtacagcctgcaacccggtggcggtgaacgccagcaggagcgcgtcagcgttatcttcaacggtaacgaccaactggtaagcctttccggtgacttcatgcctggcgtaagccgcgacgaagccatcctgggcaaggacagtggcaccaccgtgaccgcccctactgaaaacgccgaacagccaaaaccggaaaaaccggaaaaaccggccaagcctggctctctgctcgatcagatccagaaggacgtcgacaacgtcgagaccgttccggtgccaacaccagaacctctggacacctcgccgcaataatttgtggcggaataaaaaagcccggcgagtccgggctttttgttgcctgtcgatttgctcaggactccgaagtacgagcccgggcctgcgccgcctttgccgcgcgcagacgtcggacctctttagggtcagccagcagcgggcggtagatttcgatgcgatcgtccgcccgaaccggctgcctcccagggtccgcaaccgctttgccaaaaatccccagtggacaattgtccagatccaactctggaaattgcgcgcctatcccacagcctttcactgccgcacgaacagtggtccccgttggtaccgcaacactgagcaatacctgccggtcgaccgcggcatacaccacctcgacttcgatcattggttcaagcatgcaactgcttggcccgctgacaaaacgcatcgaccagggtgttggccgcctggttgaacaaaggccccaaggtcgcgcgaaccagtggaccggcgtagtcgaacgacaaatccaggctgatcttgcaggccttctcacccagcggtttgaaaacccacacgccgtgcaactggttgaacggcccttcttccaggttcatctcgatcgactggcccggcaccagggtattgcgcgtcacgaaatgctggctgagtccgcccttggcaacggccaggctggcgcgcatctgcacctcgctgctctccagcacctcggccgacgagcaccagggtaaaaactccgggtagcgcgccacgtcgttgaccaggtcgtacaaaaactgcgccggataaggcaacagggccgagcgttgaatatgtgtcgtcatgtcagcgtcatttccacaactgggcggcaaacactataagaatgccgatgggcgccacatagcgcatcaaaaacagggtcagggcaaaaagcagcgggctgcgaatcgacagctcatcacgaaccgcctcgcgccccatcacccaacccgcgaacaccacaaagcagaggccacccaagggcaacatgatccgcgaggtgaagaaatcgatcaccccaaagaaatccagaccacccgccgccccccattggtagaggtggaaagccccgccttcgttcacgaaaaacttggcctgctgccagatattgaaggagaacaccgttcccaatccgacgaaccagcaggtaaacgccagccagaatgtcacccagccacggcggattcgagtccgctccaccaggtaagccaccatcggctccagcagcgagatcgccgagctccaggcggcaatggccaccaggacaaaaaacaccacgcccatcagctggccgaacgccacattaccaaaggcaaaaggcaaactgacaaacatcagccccggaccttcactcgggttcaaccccgcggcaaacacgatcgggaacagcgccagccccgccagcagcgaaacgaaggtatccagcagcgccacgccgacaatagtgccggaaatggacgaatgctttggcatgtaagcgccgtagatcatgatggaaccgacaccgacgctcagggaaaagaacgcatgccccatggccggcaacaggccgtcgagcagcttgtcggtgctgaagtcgaacatgaaatgcacgccttccatgaaatgcccggtggtcaggctgtaacccagcaggatcagcagcatcacgaacaacagcggcatcatgatccgcaggctgcgctcaagcccggccaccacgcccctggcgatgaccaccgccgacaacagcatgaacagcgtgtgccacagcgtcagccgccaggggtcggcaatcaccgtgccgaaataggcgccgacctgatccgccgtcacgccctggaaatcaccacggcccatatcgatgatgtagtccagcgaccaaccaccaacgacgctgtagaaggaaagaatcaacaaggcggtgatcatcccggcgaacgcgccccaggaccacttggccgaatgccccgcctccagggccagcgccttcaaggcattggccgggctttgccgggcgcgacggccgatcagggtttccgccagcatcaccggcacaccgatcagcgcgatgcaggcgagaaataccaggacaaaggcgccgccaccgtagacgccgaccatatatgggaatttccagatacttcccaggcccacggcagaaccagtcgcagcgagtatgaaaacccagcgactggcccagccgccgtggacagaaaccttgtccgtcgacatcaaaaacgcgcccaaccgagaaaaaagagggcgcattgtccgggattcactcaacctgctcaagcacgcagcttcaccgtagccgacacgcgtgcaactgcctataatgccgcccctatggctaaacagaagaaacacccaacagggaccatcgcgcaaaataaaaaggcgcgtcacgattacttcatcgaacatcggttcgaggctggcatggtcctggccggctgggaagtaaagagtctgcgtgcgggcaaggcacaactggtcgacagttacgtgctgctcaaggacggcgaagcctggctgctgggcagccacttcacgccgctgaccaccgccagcacccatgtgatcgccgaccccgtgcgctcgcgcaaactgctgctcaacaagcgcgagctggagaagctgttcgcggccgtgcagcagaaaggctatgcctgcgtgtgcctgtcgctctactggagcaagcacatggtcaagtgcgagattgcactcggcaagggcaagaaggaatacgacaagcgtcataccgaacgcgagcgcgactccgatcgtgagctgcatcgcgcggtgcgcaacaagggcaaggaagagtaacgctcttctgccttgacgccatgatcgcgagccagctcgttcctaccaggagcgagctggccagcgatgaatctcccaactaaatccccttgcgccgctccgcccgggccacgcgctgcacttcctgacgcacctcttccagcacttcctgcacatacagaatgtgccgactggagacttcgcgcgcctgctcggcccgcccttcgataatcgcctggtacagatcgcggtgctggctgatcagcatgtcgcgggtttcggtgcgctgcttgtacatgccgccaatgttggtcaccacgttgcgcttgagcagatcgaacagcccgcgaatggtgtgcagcaagacagcgttgtgactggcctcggcaatcgccaggtgaaattgcgcgtctgccgcgccctcttccgcacggctcacatcgccggcccgggaatagcaatcctgcagctcctcgaaggccgcggtgagccgttcgcgatccacctcggtggcacgcaatgctgcgtaataggcgcatgaggcttccagggtgtggcgaaactccagcaagtcgcgctgggcttcagggttgctttccaacaactgcaacagcggatcgctgaaggtcgagcccagcgactccaccacatagttgccgccaccctggcgactgaccagcaagcccttggccgtgagtttctggatcgcctcgcgcaacgatggccgcgagacaccgaactgttccgccaacgcacgctccgccggcaggcgctcaccggacttcagcgtgccctcgaggatcatcccctcgagccgctcgacaatatcgtcagacaaacggcgctgacgaatctgatcaaaccccataactcactctccacgatcccgaccgcgcgccgggctctctattctggcctatcggggccccgccagcacctatcagaacgcaggtcggcgagcggatcagatgccatctgcaccgcaccttcgacaaaagttttagggcggcaaattgacacaccgctcacaaggcttttaccctagccaacagcgattgtaaattggtcttaccaattaaccaaatacgctgaccagtgcctgaccaacaacaattaggggccaccccatatgcaaacctggcaacagctttacagcccgctcggcagcctcggcctgtccgccctcgccgccgtcatcccgattgtcttcttcttcctggctctggccgtgttccgtctcaaaggacacgtcgccggcagcatcaccctggcgctatcgattctggtggcgatcttcgccttccagatgcccgccgacatggcgcttgccgccgctggctatggatttgcctacggtctgtggcccatcgcctggatcatcgtcgccgccgtattcctctacaaactgacggtcaagagcggccagttcgaggtcatccgcagctccgtgctgtcgatcaccgacgaccagcgcctgcaggtgctgctgatcggtttctgcttcggggcctttcttgaaggtgccgccgggttcggcgcgccggtcgccattaccgccgcgctgctggtgggcctgggattcaatccgctgtacgccgccggcctgtgcctgatcgccaacaccgccccggtggcctttggcgccctgggcattccgatcatcgtggcgggccaggtaaccggcatcgacgcgttcaagatcggcgccatgaccggccgccagctgccgctgctgtcgctattcgtgccgttctggctggtgttcatgatggacggcctgcgtggcgtcaaagagacctggcccgcggcgctggtggccggcctgagctttgccgtgacccagtacttcacctcgaacttcatcggcccggagctgccggatatcacctcggccctggccagcctggtttccctgaccctgttcctcaaggtctggcaacccaagcgttcgttcgccgcggccaccgccagcgtcggcgccgcggccgtgcgcaacggcggtttcggccagccgcgtaccacccagccttcgccctacagctttggtgaaatcttcaaggcctggtcgccattcctgattctcaccgtgctggtcactatctggacgctcaagccgttcaaggcgatgttcgccgccggcggctcgatgtacagctgggtattcaacttcgcgattccgcacctggaccaactggtgatcaagagcgcgccgatcgtcgccactccgaccgcgattccggcggtgttcaagctcgacccgatttccgccaccggcacggcgattttcttctccgcgctgatctcgatgctggtgctgaagatcaatttcaaaactggtctgaccactttgaaagagaccttctacgaactgcgctggccgatcctgtccatcggcatggtgctggccttcgcctttgtcaccaactattccggcatgtcctcgaccatggccctggtgctggccggcaccggcgcggcgttcccgttcttctcgccgttcctcggctggctgggggtgttcctgaccggttcggacacttcgtccaacgccctgttcagctcgctgcaagccaccaccgcgcaccagatcggcgtcaacgacaccctgctggtggcggccaacaccagcggcggcgtgaccggcaagatgatctcgccacaatcgatcgccgtggcctgcgccgccaccggcctggtaggcaaggaatcggacctgttccgcttcaccctcaagcacagcctattctttgccaccatcgtcggcctgatcaccctggcccaggcctactggttcaccggcatgctggtgcactgatcgcaacaccgaaagaaccggcgccggagcacccttgcggcgcctgcaactcacaacccggtctgcaaggctgctgaaagcttgtctctctatattcagcagccgccgcagacggataaccgggaccacccggagacacgcctgatgagcgagcttttttacaacgccgtgcctaacgcgacccgtgtcgcaccgcccttggccgaaccgcgccagtaccccagcgagaaaccgtcgcgggtctacctgttcggcacctgtgtggtcgacctgttctatcccgaagccgggatggatgcgattcacctgctcgagcgcgaaggcattcgcgtggagtacccgcaagggcaaagctgctgcggacaaccggcctacacctcgggttacaccgagcaggcgcgcaccgtggcccgctcgcaactggcgctgttcgccggcgactatccagtggtggtgccgtcgggttcctgcgcgggcatgctgcgcgagcactacgcggacttgttcaaggatgagccgcagaccttgaagcaggtgcaggccctggccgaacgcacctacgagctggcggagttcctgttgcacgtatgcaaagtgcagctcaaggacagtggcgagccgatcaaggtggcgctgcacacctcctgctcggcacggcgcgagatgaatacccacctgcacggtcgtgcgctgctggcacaactgggcaacgtggagcgggtagaacacgaccacgaaagcgaatgctgtggctttggcgggactttcagcgtccgaatgccagacatctccggcgcgatggtcgcggacaagacccgcgcgctgaaggaatccggcgcccaccaggtgctgagcgccgactgcggctgcttgatgaacatcaacggttcgctggagaaacaacgggaagcgctgcgcggccaacacttggccagcttcctctggcagcgtaccggaggtgcccgatgagcaccccggagcttattccgaccctgaccgtgtcggacgattttcgcacccgggcccaccaggccctgggtgaccgacaactgcgaaacaactttcgcagcgccatggattccctcatggccaaacgtgcggcgtcgttcagcgatgcccacgagcgcgaacacctgcgggccctgggcaatgcgatcaaggcccgtgcgttatccaagctgcccgacctgctcgagcagcttgaacagaacctgacccgcaacggtgtgacagtgcactgggcggaaacggtggacgaggccaatggcatcgtcctctcgatcatccgggctcacgaggcgcggcaagtgatcaagggcaaatcgatggtcagcgaagagatggagatgaaccatgtcctcgctgaacaaggcattgaatgccttgagtcggacatgggcgagttcatcgtccagctcgaccacgagaagccttcacacatcattatgccggcgatccacaagaacgccggtcaggtcgcgtccttgttccacgacaaacttggcgtggagtacaccaaggacgttgaccaactcattcagatcggtcgcagggtcctgcggcagaaattcttcgaagcggacatcggcgtctccggcgtcaacttcgccgtggccgagaccggcaccctgctgctggtggaaaacgaaggcaacggccgcatgtccaccacggtgccgcccgtgcacatcgccgtcaccggcatcgagaaggtcgtcgagaacctgcgcgacgtggtgccgctgctgtcgctgctgacccgctcggcgctgggccagccgatcaccacctacgtcaacatgatctccggcccacgcaaagagcatgagctggacggcccgcagcaagtgcacctggtgctgctcgacaacggtcgcagccaggccttcgccgacagcgaattgcgccagaccctgaactgcatccgctgcggcgcgtgcatgaatcattgcccggtctacacccgcatcggcggccacgcctacggcgaagtctaccccggccccatcggcaagatcatcaccccgcacatggtcggcctggccaaggtgccggaccacccgagcgcgtcttcgttgtgtggcgcctgcggcgaagtgtgtccggtgaagatcccgatcccgagcctgctgcgccgcctgcgcgaagagaacgtcaaggctccggacagcccccatcaggtgatgcgcggccagggcagcaagtactcgcgcaaggagcgttttatctggaacgcctgggccaggctcaacagctcacccatgctgtatcgcctgttcagcctggcggccacccgcctgcgcgcgctgaccccgagcaacgtcggcccctggacgcaaaaccacagcgcaccgaaacccgccgcccggtccttgcacgacctggcccgcgagcatctggccaaacagggagaacgtcgatgagcgccaaacagaacatcctcggcaagctgcgcagcagcctgactggcaccacgccagttgtggataacttcgatgaggcattggtcaccgagccttatacctacacaccggaacaacgcatcccgcagctgcgcaagcagatggaagcggtgcacaccgagattcatcagaccaccgcccaggactggccggcgctgctcgcccgcctgctgggcgaacgccaattaccgagcctgctgatcgccccgaccacgccccacggccggcgcgtcagccaatactgggccgagcatcccgggttgccgacgttgaaggcctacgatcggcccgtcgaggaatggaaagccgagctgttcaacgacaccccggccagcctcaccaccaccctcggcgccatcgccgccaccggcagcctgatcctctggccgacccgcgaagaaccgcggctgatgagcctggtgccgccggtgcatttcgccctgctcaaggccagcgagatccgcgacaacttctatcaggtccagcaggaatacgcctgggcccagggcatgccgaccaacgcgctgctggtgtccggcccgtcgaagaccgccgatatcgagcaggtcctggcgtacggcgcccacggcccgaaagacctggtggtgctgattctggaggaccaatgagtctaccggcggtttttctgcgtgatgcccaacaactgatccctcaggagcggcgtttcgacgacccgctctccaccctggccttcggcaccgatgcgagtttttatcggctgactccgcaactggtgatccgcgtcgagtccgaagacgaagtggtggccctgctcaaactggcccagcgcgaccgcgtaccggtgacctttcgcgccgccggcaccagcctgtcggggcaggccatcagcgattcggtgctgctggtgctcggcgataactggaatgcccgcgagatccgcgaccagggccagcagatccgcctgcaaccgggggtgatcggcgcccaggccaacgcctggctggcaccgttcgggcgcaagattggccctgatccagcctcgatcaacgcctgcaagatcggcggcatcgtcgccaacaatgccagcggcatgtgctgcggcaccgcgcaaaacacctatcacactctggccggcctgcgcctggtgctggccgacggcactcgcctggacaccgaagacgccgccagcgtcgcggcctttcgcagcagccacggcgaactgctggaacgcctggccagcctcggccgcgagacccgcgccaacagtgaactggcggcgaagatccgccataagtaccggctgaaaaacaccaccggcctgtcgctcaatgccctggtggatttcgatgagccgctggacatcctcagccacctgctggtgggctccgaaggcaccctgggttttatcagcgcggtgacctacgacacggtgatcgaccacccgcacaaggcttcggcgctgatcgtcttcccggatgtggaaacctgctgcaacgcggtaaccgtgctgaaaagccaaccggtgtccgccgtggaactgctggaccgccgcagcctgcgctcggtgcaggacaaacccgggatgccggccttcgtccagcaactgtccgccaatgcctgtgcgctgctgatcgaatcccgcgcggcatcttccgcgctactccaggaacaactggcgcagatcatggcgtccctcgcctccttcccggtggagaagcaggtcgacttcaccgaagacccgaaggaaaacgccaagctctgggcaatccgcaaggacacctttcccgccgtcggcgcggtgcgcaaaactggcaccacggtaatcatcgaagacgtgaccttcccggtggaacagctggccatcggcgtcaatcgcctgatcgcgctgttcgacaaacaccactacgacgaagcgatcctgttcggccatgcgctggagggcaacctgcatttcgtcttcacccagggcttcaacagcgccgaggaagtggcgcgctaccaggccttcatggatgacgtggcacagctggtggcggtggaattcggcggctcgctcaaggccgagcacggcaccgggcgcaacatggcgcccttcgtcgaactggaatggggcagcgatgcctaccagttgatgtggcaactcaaacgcctgcttgatcccaacggcatcctcaatccggacgtggtgctcagcgaagacccgcagatccacctcaagcacctcaagccgctgccggcggccgacgagattgtggataagtgcatcgaatgcggcttctgcgaaccggtgtgcccgtccaaggggctgaccctgagcccgcgccagcgcatcgtgatctggcgcgatatccaggcccgcaagcgcgccggcatcgacaccaccgaactggaagcggcctatcaataccagggcatcgacacctgcgccgccaccggcctgtgcgcccagcgctgcccggtgggcatcaacactggcgagctggtgaaaaagctgcgcagccagcacgccacgcacgccaaggcggccgattggctcggctcgcacttcgccaccaccctgcagggcgcgcggttcatcctgcacgtggccaacggcgcgcggatgctgctgggggcgccacgcctggccagggtttcggcggcgctgaccaggatatccaagggccaggtgccgcaatggaccagcgccatgccacagccggaacgggccattcgcttcagcccggccgtcagcgaccagcggccacgggtggtctacctggcggcctgtgtgtcgcgggtcatgggcccggcggccggggacaaagagcaaagctcgctctacgacaagacccgcggcctgctggaaaaagccggttaccaggtggtgatcccggacaacgtcgaaaacctgtgctgcggccagccgttcgcctccaagggctacgcggaacaggccgagcacaagcgccaggaactgatcggcgccctgctccacgccagccgcggcggcctcgacccgatctactgcgacaccagcccctgcaccctgcgcctggtgcaggacctgggcgacgtgcgcctggacctgtacgacccggtgcgcttcatccgcacccacctgatggacaagctcgagttcacccctcaggaagcgccggtcgccgtgcatgtcacctgcagcacccagcacctgggcgaaagccaggcgctgatcgacctggcgcggcgttgcagcaacaatgtggtgatcccggaaggcatccattgctgcggcttcgccggcgataaaggtttcaccacaccagagctcaacgcccacgccctgcgcagcctcaaagacgcggtgcagtactgcagcgaaggcatctccaccagccgcacctgtgaaatcggcctgagccagcacggcgggatcgattatcacgggctggtgtaccttgtggaccgggtgacccaggcccggcaagcctgatcggcacaagataaaaaggggcgtttcgccccttttttacgtccgcaggttcagtggtcgcgcccctgggcagaaaaatagaaccctggcgaaccaccgcagtccaccgatcaagcccccgaaaacgggagcttcctgaaacccggcagttcgtactgatggccagcagtgcttggcccttcagttcaaggagacgcccatgaaacgctctgtactgttaggcctgttcgtcaccgcttcggtcctggcttcccccagcttcgccgggaaccaggaagacctgtgccaggtgaacctgcaaaccatccgtgatgcacggaccaccatccaggccgcggacctgcaggccaacatcgacgccaccgtgcaacaagcccaggcggcccaggcgaaaaacaccgaggaaggcaccaaggaatgcatcgccctgaccacccgcgcgatccagaccatccagaacagcgccaagggtgaaggcggcggctaacaggccccgccttcgggatggccttgcggaccattttggcgtaaactgtacaaacctgctggtaatgcacagcaggttcggggccgtttaggattcgacgccggttgcgaaactttaggtgcatgccgagttggtaacagaactcgtaaatccactgttgcaacttcctatagttgccaatgacgaaacctacggggaatacgctctcgctgcgtaagcggcgctagccttccttctggtaccttcgggtccagcaatcatcaggggatgtctgtaaacccgaaatgattgtcatacagaacagaatcgccgtgcagtacgttgtggacgaagcggctaaaacttacacaactcgcccaaagcaccctgcccgtcgggtcgctgagggttaactcaatagacacggctacgcatgtagtaccgacagcggagtactggcggacgggggttcaaatccccccggctccaccaaacgaagcaaaaacaaagcccgccttgtgcgggctttgtcgtttctggcctctcagcccccccttcccttggcagctcctgaagcggcacacctgcagaacactcaaaaaagcccccccaactccaccccctccgccatcgccctattcccctcatcccccggatgcaggtgatcgcccgaatccacccgcggcaacaaccgtgctggatgctgtggatcgcgagtcatccggtcgaaatcaatcaccgcatcaaatgcccggctgctgcgtatccattggttgagcgcctggcgcagttgttccttttgtgggctgtggtagtgctcgatgatgctgccttccagggcgccttcgaagggcagcagtgtggtgccgatgatgcgcaggttgtggcgatgcgcctggtcgatcagttgttgatagccggcgatcagctcgtccagtgtaggcaagggtgcgttgggcgcgaaggcggtgccgggccagctgatgtcgttgattcccagcatgacaaccacgcttttcacgccgggtttgctcagcacgtcgcgttcgaaacgtgcccgtgcgctggcgcccatgccatcttcgagcaggcgcgcgccggatatgccgccgttgagcacggcgatgttttcggcggccaggcgctgggcgaggaagtcgggccagcggcggttgctgtccagggtcgagccgttgccgtcggtaatggagtcgccgagcaccaccagggcgcggctgtcgggcgcggcgtccaccaggatgtcgctgaggaacagccgcgcttccacttgccgctcacccgctaactgctgagtgtcgacgtggttgcccgcagcgataaacgcggtttgcttgccgtcccagtggaaggtggtcagcggcgtgggctgcggcaggtacagcgagacaaccagctcaccaagggccggcaccgccaacgccaccgggtcgctggtgcgggtttcgcccggcgcgatgctgacctgctcctcgccaccaaacttcaggacttgtccggagccggcgcgaacggactcgccctcctgcatggcggcgacccgcgccgcgccgatcagcagcggctgctggccgtattcgttggacaccaccacccgcacccggctgccaccgacgctgacgcgcagcttctgctggacggtgctgtcggccagggtttcgggaatccgcgtgggcagcggcaactcgttgccccaggtcggttgcgggctggccatccaggtggtgagccagttgtcctgggccaggaccgggcctgcggcgagcagggccgtgactatcagcggcagggaaaatcttgagtgcagggctttcatccggtagctccttgaggccgtaaggctgaggcgagccagattgctccattcgaaataaccgtgatagaaggcataatttcatacagcccattccgatatcgaatacccatggacagtctcaaagcgatgcactgtttcgtccgcgccgtcgagttgggcagcctgtcatcggccgcccgggagctgggcagcactcaacccaccgtcagcaagctggtggcggccctggaacagcagttgggcacccgcctgctcacccgcggcaccagtgggctgacgcccaccgaacagggcaagcgtttctacgagcgggcgaaagcggtgctggaggaatacagcgaagcggtggccgaggtgcgcggcctgaccgagcgccccgagggcgtgctgcgggtcaatgtgccggtgagcctgggggtgcggcatctgaacgccttgctgctggcgttcatggcgcaatacccggacatcgaggtggagctgatcttcaacgatcgtttcgtcgacctcaccgaggagaacgtcgacctggccctgcgcctgggcggtgacttgccgcccaacgccatcgcccggcgcatcgccacgtcgccgcgctacctggtggcggccccggagtacctgcgccagcatccgcccttgaacagcccggccgacctgggcgagcacaacttcctgcgcttcgcctggctggcggcgggcgaccgcctggagctgagcggcccgagcggcgagaaggtcagcgtcaccccccaagggcgctaccggagcaacagctcgttggccatccgtgacggcgtgctgcagggcgctgggctctgtgtcaccccggcctggctggtcagcgacctgctggacagcgggcaactggtgcgggtcctgcccgactggagcgggccagccaacgaggcgttcctgatctaccccgagcgccgctaccggcccctgcgcgtgcgtttgctcatggagtacctggccgagcgggtggcgcggttgccgggcttcattccctgaacccagggccagcgcgttgcctgccatggacacgatcaatggccattacgatccccttttggccaaccccgtgctgtgaatcccagaggccgtcggcaagaatcgaacccggaccactgactcggtggcccaggctgtcaccagaaccgcccttgtgaaccttgaccctctttgtcctttgcctttcaaggaccgcctgccgtgtacagaacataaaaaccatcgccacgctggggaaaccattcatggccactatgaaacgcatactgagtgccaccgtttgtgggctgtcgctgctggccggcgcggcacaggccgagcagcgtgagctgcgggtgtacaactgggccgactacatcctgccgtcggtgcccaaggacttcgccaagaacagcggcatcaaggtgacctgggacaccttcgacaccaacgaatccctcgaagccaagctgctgaccggcaactcgggctacgacctggtggtgccgtcgaaccagttcctcgacacccagatcaaggccggggtgttccagaagctcgacaagtccaagctgcccaattggaagcaccaggaccccgagctgctcaagctgctggaccgcaacgacccgggcaaccagtacggcgtgccctacatgtacggcacggtgctgatcggcttcaacccggccaaggtcaaggcggcgctgggcgacaatgcgccggtggacagctgggacctggtgttcaagccggagaacatggagaagctcaaagcctgcggcgtggccatgctcgactcgccgtcggaaatcctgccgctggccctgcattacctgggcctggaccccaacagccagaacccgcaggactatgaaaaagccaaggaactgatgctgaaaatccgcccctacgtcacctacttcaactcggccaaatacatgaccgatatcgccaacggcgacatctgcgtggccatcggctactccggcagcttctaccagttcggcaatcgcgccaaagaggctggcaacggcgtggtggtggactggcgcctgcccaaggaaggcgcgccgatctggttcgacaccttcgccattcccaagagcgcgaagaatgtcgccgaggcccatgagttcctcaataccctgctggacccgaaagtcatcgcgcccatcagtgatttcctcggttacccgaacgccaacaaggattcgattgcgttgatcaacaaggagatcaccggcaataccgacctgacgccaactcccgaagccctgaaaaagctctatgtagtgcagccgctgccgcaaaagctggaacgcgtgcggacccgggtctggaccagcatcaagtcggacaaataatccgcccttcaggcagccccgccctggggctgcctggccttcacttcagctcgaacaccaggcagggattgtcattcaagcgcccctcgaacaccggggtcgcctgctccagcgcagttcccgccagcaatgcccgatccttgcgcgccaggatcacccaggccggacgcggcagcgacgccagcggcgccagatcgtccttgccgataaaccgcggctgctcgtcgtggtccaggttcatcatgtagcgcaccgcccaggtgtctttgcccaggctgagaaagaccaaggtgccgcggtcctccccacgcagttgctcgatctggtcgacaaaaccccgggtggcgaattgcaggtccttggccggctcgatcaccttcaccagcagccaccactgcgccgccagggccaacaagctgagcagcaccaggcgccgccccggcgcgtcgcgagtggttcgccagcagtacagcgccagcccctgcaaaccgagaaagaccgccatcatcagcggcaatgacaacgccggccaataaccgtgcttctgccagctgtgccggcagaccagcagcaccacggcgcacaaccccggcaacagcgccaccaggccgagataaaaccagcgcaccctgagcagccagcgctgcgggtggagcaggccgtaagccgcgaccgccgcgaacatcggcaccatgggcaggatgtaataggcacgcttgaagtgcggcaccgacaagccaagcaggatcatcaatccacaggcgcccaggcgcgccagcagttgcagcgtgtcgtcggagtgccgcgtggaccattgccgacgcaggacgaacagcgtcgccagcgccagcggcaccaccgggaagtaccggtagaggctgagctggaagtaaaaatacagcggctcgccgctttcatcgaggcgcccgccgacctgcatctggtagacctgccgggcgaaggcttcgccgccactgaactgcgccagttgcatcaacgcccaccagcaggcggccagcaggatcaggccgatcagcccatggacgagcaccttgctcaacagccgccagccgtcgcccggtgcccggcaagtactcaatgcccagtaggtgcaggccacgccgcagacctcgatcagccccagggggccgcggatagcgaaggcgatgacgaatagcggaaaaatcgcgtactggcgccacttagaacccagctgctcaccgctgtgcagcaggtaaaaacagcccaggcacagcaacgagaccatctggtccaggcataccgagcgcgacttctccagccactgggtggtgagcgccgtgagcagcaccgccagcagcgcccaggtgcggtcgaacggcgccagcaggcggtacagcagcgccagcaccccggccgaggccagcgccgtgggcaggatattggccagttcgttaggggcgccgaagagctgggcaaagccatagctgaacaaggtggcggtgcccggatagtccggataaggctcgccataggtggtgggaaacaggctcgcgccgtggcggaacatctcctgcaaaaacaaccaccagcgcccatcgaagccttgcgccggctggtcccagatgccgaacgtgaacagcagcagggccagcaggaaaactgccgaagactccacgccaaaacgttgctgctgactcatcatctacccgccaggttgatcgccactcagtgggcgtgacggcaagcatgttgcgggaacaagtgctgaacgatcgctgaacgtttatcaggattcatcgaaccctcgacagcggacaaaaaacggcccggcgggatcgccgccaggccgtattcgagtcattgcgcgatttacagaaagaccgccgagagcatgcccagcgcgcccaggcaacaaccgatcagggtgccgcgccccggcaactcacggaacaccgaccagatcaccagcggttcgagcagcaacagcgaggtcaccgacaccaccgtgatcatccagatatcgccgaccgccaaataacccagccaataggcgccaatcaggcagataccggcgaaacacatgatcaatacaggcaacgccaggtccggccatgacgtgttgcccgtatgcgccaggcgggcggcgaccacttcgctgtagatcgcgcaaaactcgcccagcaccatcagccctacagcagaaactccgagtaattctttggacatatgacaaaccccttggtattgagagccagatttttcagctcccaggcagcaatggctccgctgacggagccgccatgacgatgccgaggggtttgctctaattcagtgaccgtaaggaacctgaacatgtccatctcctgcgtggtgggtggtacgggcgcccgcgaacgccatgggcgattgcagggtgctagctgtatagggtatttccgaggcggccgacacgcgtttttttgtagagtttttgtctgttcgccgccacaagggccaatgccgccagccagaaaagccttcgctactcggcccggaagttccagacgatctccaccacccgcacggccaggaccaggtacaccaggaacagcgcgacctgcagcagccggtgataaggcagcctggccagccggcgcaggccgtcgctgacattgagcagcatcagcagcgccgacaccccgatcagcccccagccggtcaggctggagccgaacaggcccaggaacaggtggtggtcgctgtgcagcgcattggtcccggcggcgaacagcaaggcgcagaccagcaggttcttgacgttgtcgaagacccgcgtgttcaggtcgccgtccagcaggtccagatactttcgccacagtttgcgcatgttcaaggcacctgttcagccgtaggaaagaaagacacccagggcgttttcaaagatcaatcacccgccgggcgcacctcccagcgtagtgacgattgccacaacctgcttgcggtcgttcaaccccatgcggtgcaccccgttcaacaaggaaaacaggcaggagcctgctgctccccaatccctccctagttcacgatttgttaagaatcgcctccgtatactcggaacgcctgatcctcccccggcgccacctcttcggcagtccccccatgtcgcgacccgcaccgctgttgcttctgcttgccgccctgctgttcttcttcgccctgggcaaccaccagttgcagggttccaccgaagcccgggtcgccgggatcgccatgcagatgcacctggacgatgactgggtgacgccgcgcctgttcggccagcccttcctggaaaaaccgccgctgagcctgtggctcgatgccagcgccatccgcgtattcggtggcacgccgtgggcggtgcgcctggcctcggccttcgccgggctgttcagcgtgatgctgctgtacgccatgctgcgccgcttcggccggccgccagcggtggcctgggtcgccggcgccatgctcgcgaccatggccagttactggggcaatgtgcgcggggtcggtgaagacgccctgctcagcctcggcgtaaccctggcgctgctggcgtttttccacacccaacggcgccaggccgaaggccagccggccaccctgggctggctgctgttcgccctcggcatcgccatcgccaccctgagcaagggcgtgctgggcctggcgatgccgggcgtggtgatcttcgcctggctgctggtcgacagcctgatcgaaaagcgcttcgccctcggccactggctcaagcctgccctgctgaccctgctcggcctggtgccgctgctgatctggctgtgcttcctgtaccagcgcgggggcctgcaagccctgggcgaagtgctgtggaccaacagcgtcgggcgcttcgatggctcctttgtcgaggccgggcactacgagcccttctattactacctgggcacactgccgcaagccttcctgccgtggaacatcctggtctacctgggcctgtggcactttcgcaaaagcctggtgaaaaaccgctacctgctgtttttcagcctgtggctcgtagcccagttcaccctgctgtgcctggcgtcgagcaagcgcaccgtgtacctgatgtcgctgaccccggccgcggcggtgctggcggccgaatacgcgacagtgctgcacgaacgcctgcgccagcgcgccgcgggcgatgggttctggagcgtcgtggggcgtcagcgccgcgacctggccattggcgtgctgacgctggtggtatgcagttacctggtggccgcgcagtgggccgcgccacgcgccgatcgccagctgtcctttgtgccgctgatcagcgagatccagacgctgcaggccgccgggcagcaggtggcgctgtatcaggccaacgaacgcgcggccggcgccagcgtgttctatacccagagcctgctcaaggatgtgcagaccgaagcccagctgaatgagtttctcggcacctcgccgaacaacgtagcggtcatggccctggaggaagaccccaagccaccgctcaaggtactgaagaaggtcacggtcagtcgccaggcctactactttgtcagccactgaccggcacagtgagcgcatataaaaaaggcaccctcatgggtgcctttttttatctcgtcgccaggctttcgcgctggcgccggcatggctcactgaacggttttcagcttgaccacatcgccggagaccttggtggtgtaaccgctcaggacccaggcccagaaccagttttcctggatctgggtgttgatcatcgcgtcaccgcccttggcctggatggcggcggtctgggcgcgaacgaagcggttgttctgccggattggaatgaccccgaacagcatgatgccggtagccgttgcttcgctgtgaccgaccacggtgtactggctactatccagttgctgagttttcatcgcagtgccggtgcagccagccagggccaggacaaccagcgcagaggcggcaactttgctcaagtgtttcatgcatgactccataaaccaggaacccgggaactcttttctccgggggcgcgcaccctaacagttctggtcacccaaaaaacatcggcaagcgccaaaaattgcgccggggccctctcccgccaggtgcctggcaccgacgattcagtcagctactgaagcaccgttatcgatcagcaccgcggactgctcggccccaggttcggtgtgcgccagcaccggctgctccaggcgcgcgcggccataaaacagcagcgccgtcagcaagcaggtgagccacaccacgattcccgcccagaaggtatgggacatgtagtgccaaccctgcagcacccgggtggtgccatagacgaagcccagcagcagcgagccgtacagcagcgccttggcgtggcgccagcgataacgccgggccacgaagtacagcgccagcagggtgaaaccgcccgaggcatggccgcccggccagcagcggccgtcaccggcggtcttcagcagctcgaagttctcataccactccttgtgctcgatcttgccggcgtactgggtggtttccaccgggcagtacacgctggtgtggcccttgaggtagtgaatcgccccggtgcacagggcgaaggccaccaccacgaacagaaagtcccggcgatggcgcgcggtaaaacgcaataccggcgccacgcggagcttctccagcagggccttgccgcggccgaaccttgcgcccttgaacaacggccagacaaacgacagcagcagcccgatcagcgccagctcgccggtccagttggggatgatccgcgcccatttgtgggtgatcttctcgaacagatgggagtgatccagcgggaaggtctggctcagcggatcgaagaacaggtcgctgaaggcgatgtcgatccgggtcatgtcgaacatcaggaacaccagcgccgcgcacagcagcggcaggccaaggttccatccataaaaacgccacgcatcagcgcgggaacgggaaagcgccggcatattcagagtctcggacaagggacggtcaggggcgattgaaggcgacggaacgccagtcgctggcttcgatgaagccaagcatgtgcggacgcccgtcgagggtatcggtggagacgaacaacgaggcgccgtagcccagggtcgaagacggcagcttcagcgccttctccagcgcggccatgcattcgctgtgggtcaccagcaccaggttgcgcccggccaccttgtgcgccagggcatcgcgcaacaggctgcgtttgcagtcgaacagccagtcttcgccactgccggccttgctgaacatataacccgaggtctgtaccgcgcgggtcagcgggctgtggtagatgtcggccttgtccagccccaggtgttcgaactgcgcgcccacacccaccgccacgtcacgggcacggtcagtgatgccgtcgggcacgttcaggcaggcggccctggaatggtcgcaacgctcgacgtgacgaatcagcacaatcatctggcccttggcccagccggcgctcaaggccctggcgccggccaggttgccgtgggccaggtccggcaccgccgcgggcttgagcacaaagaacaccagcggcagcaccagcaaggccaccagggcgatcaccaggctattgcgataacgggcaaaacggctcgcgacgagcgcgggctttgccaccggaagactgagtcctgacgccacgtgcgagccgcccctatatgaccaccagacattgagttgagcagcgcagcagacgctaaccgccgctcatgacaaatcgggtgcgtggcacccgatcgagggtcggactttaggcagcgaggcgtggccgcccagtgaaacggatgtgaaaaaaagctcaatcggccaggcggtttctggaacgaaatccggcccttgaaaagccccaaaatggtgcaaaaaactaatgcgacgaaatcgtttcagctattgcccttgccgccgatacacacctgcgaacaaatccttgctggccaccaataacaacaatcttccagcgatacacgatcaagcagcacaacgttcctggaggaattgcatgaatagctggttcggcaacatcagcgtcaatctcaagttaggcctgggcttcggcctggtcctggccctgactaccatcctcgccatcacgggctggaccagcctgggcggtctgatcgaccgcagcaactggatgagcgacatcacccaactgaacgccgggctgaccaagctgcgcgtgacccgcctgcaatacatgctgaccaacggcgacgaaaccgccgcgcagaacgtgcaggccaccctggacgccttctcggcccagcagcagaagttgcagggcaccttcaagaacccggccaacgtcaagctgctcaaggagcaaggcgccaccatcagcgcctaccaggcgtccctgaacaagatgcgcaacgcctaccgcaacgccaatgccgtgcgccaggtgatgagcgaccattcgcaggcagcgcgcaacctgatcgccgccatcaccgcgcgcgtccagcaaatgcccctgagcgaccaacgcttcgaacagttccaggccatcaccaaggccaatgacgaattccagctggcgcgcttcgaaatccgcgaatacatctacaacagcaccgccgacgccgagcgcaacgccgtggcccagatgaacgcggcaattgccgcgctcgctggcctggacagccatttcagcagcacccaggccgatgccctgcgccagctcaacaccgccctgagcgactaccgcaccgacctgcaagccttcaaggccgccgtcggcgaagccgcgcaagcgcgcaaggaaatgaccgatcagggcgccctgatcgtcaagcagagtgaagagctgtaccagttccagctcgaccgccgcgacgcggaaagcgcccaggcccgcagcctgcaactgatcagcaccctgctggcgctgctggtgggcatcctggccgcggtgatcatcactcgccagatcacccgcccgctgcgtgaaaccatgaccgtggtcgagcgcatcgcttccggcgacctgacccaggacgtgcgcgtcacccgccgtgacgaactcggtgtgctgcaacaaggcatcggccgcatgggcgtgaccctgcgcgaactgatcagtggcatccgcgacggcgtgacccagatcgccagcgccgccgaagagctgtcggcggtgaccgaggaaaccagcgccggggtcaacagccagaaggtcgagaccgaccaggtggccaccgccatgcacgagatgaccgccaccgtgcaggaagtcgcgcgcaacgccgaagaagcctcgcaagccgcagccgccgccgacggcgaagcccgcgaaggcgacaaggtggtggccgaagccatcgcccagatcgaacgcctggccagcgaagtggtgcgttccaccgacgccatgagcgtgctgcaacaggaaagccagaagatcggcagcgtcatggacgtgatcaaggccgtggccgaacagaccaacctgctggcgctgaacgccgccatcgaagccgcccgcgccggtgaagccggtcgcggtttcgccgtggtcgccgacgaagtccgcgccctggcgcaacgcacgcagaaatccaccgaggaaatcgaaggcctggtggccggcctgcagaacggcacccagcaagtggccaatgtgatgaacaacagccgcagcctgaccgacagcagcgtcgacctgacccgcaaggccggtgtctccctggagaacatcactcgcacggtgtcgaacatccagtcgatgaaccagcagatcgccgccgccgccgaacagcagagcgccgtggccgaggaaatcagccgcagcatcatcaacgtgcgcgacgtctcggaacagaccgccgccgccagcgatgaaaccgccgcctccagcgtcgaactggcgcgcctgggcaaccagctgcaaatgatggtcagccacttccgcgtctgaccctcaaggccctgtcgcgagcacactcgctcgcgacaggccgcccaccctccccaatccctgtagccgctgccgcaggctgcgataggaccgaaggtcctccagcggtatcaagaccttgcgtccgcttcgtcggaatgccggccaggccgatcgcagcctcgcgggctcggcagcggctacagggttcgggttccagattccaagattcggggttcggggttcgggttcagacctgcgttggcgggcggctgccgtcgagcagcgcatccaccacaccccgtgccatctccacgttatggatcaacgaccagatcaggccacgctccacaccgctggcccgctcggtgatctcatcggacacctcctcggccgccttgagcaggatcgaaacgtgaagcaacgcctcctcggcgctgatgccctcgcgaacacaaaacaacgagtcacggccaacgacagtgcccacggttggcttgagcgcatccatcggcgaaccatcaccacgaggccggcacagcgcctgaagcatgctttcattggcacgatcatgctcaggatttctacgtgagcacggaagggaaacgggtggatcggggacgagctttttcatgacgtaactccggagtagtggagctatcacccgtcgctgctaaacgaaaatagggtggcagctatacgcgggttagcagaccaggactccagagacccagcgcacccaagggtgccccgcgcacagctgccataacagacaagtcgacaagaaatgccaacgagttagatagggagcttgtacgtctggattttcctcgagctgctaaacccgatcaccgaaaaaccggtgacaaacccgaggctagacagcgcccttcccagacgcaagcgacccggagtttctcggaaaagccttacaaaagaaagcgaagagcctcactttcagacagcgtcttacacgacaaaacacgtcatccgcaggacctgatcgcgagcaagctcgctcctacaaaaagcgccgatataaccggtctgtagccgctgccgagcctgcgaggctgcgataggaccgaaggtcctccagcggtctcaagaccctgcgtccgcttcgcggccgatcgcagcctcgcaggctcggcagcggctacagggttagcgccgaccggtaggtcgcgtggtgcagcttttgatcttgatccagccgccctatcgggaagaacctcactctcagacagctccatacacgaaccaacgctcacaacccctgtagccgctgccgcaggctgcgataggaccgaaggtcctccagcggtctcaagaccctgcgtccgctgcgcggccgatcgcagcctcgcgggctcggcagcggctacaagggttagcgccgaccggtaggtcgcgcatggcgcagctttggcttttgatcttgatctacccgccccatcgggaggccgagtggaggtgttcatcagggggatggcgcgcagcgcccctcgacgcagtcgaggacatcgtatggaggtcgaagcgaagccgaccggagtcgatgccccctgatggacgccggagcgagggaacctgagcgcagcgaaggccgtacgcaggggcatgaacgggacaaccacataggtaacagaaaagttcaggcacataggtaacaccaaatcaggcctatgacgccggactgagcctgatgtaaccgtcctgggcatctttcaaatcaaagcgacccaacttgatcgggccaaatatgacgtcccaaataccctcactgatacgctccagacctaccgtttcgcgcttgagcacattgccgacatagatcctgagccgacctctgttgacgatcccacaagagtcaacgacataggtttctatatggctgggatacctcatcactggtagccgtgccggataagttcgatccgaacagcaataacaggaggccggtgttctctgcccaagcgcctcatgcggtcgttcatgattgtagtgctgctggaacagatcaaagtgcttttgctgagcgccccattcaatttccggaggactgaccagcgtgcttttcagcgtgcggtgcatgcgttcatgacgaccattttgctcgggtcgacccggttggattcgctcgggaatgatgcccagacgtagccaccaaattgacaacagcgacaaccccgcacgccccgcactggcgaaaggaacaccattgtcagtgcgaatgcgttcgggcatcccataggttttgaacaaccgttcgaacgttttttgggcgtctttgaagttggtgctgggcatgctctcgcaggccaacagaaaacggctcgcatggtccatgaccgtcaaggggtaacaccagacgccttctcctgtcaggtattgccctttgtagtcagcgctccatagctgattggggaggtccgctctcttcaacggaattgggtagattgcaacacgctgacgcaggcgtcttggcgttatcaaaccagcccgcttgaggatgttgtagatgctggttttagagggcggctcctgccctggaaaacgctcagccaaagccacctggatcttcttggggcccggtgtcgtaggtcctttggagcgcaactcgatgatcgaggctttgatttcaaagggaatgatatgtgcctgagcatgccgactgcgactgcgctcatccaagccctgcacaccctctgcgttgtaacgggctacccatttgtagcccgtttttcgactgatgctgtgtgccgcacacagttcgcggaagttaaagcgtctcgacagatagtcggcaatgaacatcactttaaggtccatagggttcagctctcgccacggcatggtcagctcctcggaatcgaccctgccagttaaaaactgttacctatgtgcttgaacttttctgttacctatgtgggtgagtcataccggcaagcgtttttgcttacttttttggcgtctgtaaaaagtgagtcgccgtaagggcgaaaccctaagccgccgttaccgcagaaacggatatgtaccccgtccaaaacaagcagcgaaaccaccaccgccatcgcggccaatcaaacatcgaccggccgctcctacagaagcccgaactactcaatccgccaaatccgcaccgtggcattcttcaactccaacgaccactcctcttgcgacaaacgaagccgccgcagcacctcccccatctgcgtctccgccacataatccttggcaatcaccagaatcaggaacttgttccgaaacccctccatccgtcgcaaccgatgcagatcggcaaacaccgaccagaccagagactcacccggatcgacttgaggaaaccagagccggccatcgccatcctctcgcaacacggatcgggtctcgcccatccccttgcccatcaggcacctggcaaaagacacatcccccaggcatttcacctcggccgccatgtcgagatcttccgtgtacaggtcgactttcgtacgtcctccggccttaccactggtccagatatccggataatcgtgctgccaggcatacaggctgagctcggcctgaatccagtgctcccgacaatcgctcagctccagcacctgcgccatgcgctcgctgatcgcatcaaacgccccgagaaaaacctccggccatgcaatggctgtgttcatttttttggactccgttcctgaaagggtcagggggagctttcgcgctccccaagcgtgccggcctcttgagtatcggcacccattgccgcgtcttgacccctgcaccgccgcgccagcccgaggcaagacgaagccgccccttaccgggtcccgcgcaagcgcaacgccgacggtatgtcgtcggccgtgcgcaaaccgtcggacgccgcaatcggtgtgtcgtacgccaggttcggcgcgcgccggcaaaacccgggcacgacaaccgctggcgtgcgaccgggttcaggccgggtaaccggtgatctcgcggatgctgcggtacagcgggctgagctggcggtacatgcgcacatacacctcgcggtacagccgttgatagagctgctgcgcctggggttgtggctggaagacctcggcgacgcgggtcatgccggcgatggccgtggggaaatccgggtacaggcccagcccgaccgcacaggcaatcgccgcgccgagcccggaggcttcgtacacatgcggccgctcggcgggcaggccaaagatgtccgccgtcaattgcatggccgcatcgctctgggaaccgccgccggccacccgcaagcaggtaatcggggtgcgggtgcgctgctcgatgcgttccttgccctggcgcagggcgtaggccaggccctcgagaatcgcccggtagatatgcgcccgggtgtgcacgtcgccaaagccgatcatcgcgcccttggcctcgacgcccggctcgcggattccgggcgaccagtaaggttgcagcatcagccccatggagccgggcggcaccgcgttgaccaacgcatcgaacagcacctccggctccagcccctgctcgcgggcctgctgcatttcccgcaggccgaactcctgcttgaaccagctgaccatccagtagccgcgatagatcatcacttcgcagttgtaatggtcgggcatcgccgaggggtaaggcgggatcagcgggatgatttcccggtagcgggaccgggtggtggtgatggtcgccgtggtgccgtaggacaggcaggcggtgccgctgtcctgcaccccggaacccagcacttcacaggccttgtcggcccccgcggcaatcagcggcaggccttcgggaatcccggtcagctggctggccgcggcgctgatatgccccaggacctcgcccggcttgcgcaggctcggcagctgctcgggacgcaccgccagggcctgccatttccagtcacggggcgcggcccagcgcaggcgcttgtagtcgaagggcaaaaaggccacgcaacagccgaccgagtcgacaaaacgcccggtcagccgatgggtgagaaagcccgacagcagcaacagcttgtcggtggccgcccagacgtcgggctggtgccgggcgatccagttgacctcggcctgggcgcgaaagtaatccaccgtggcctgggccccgatcagcttgaacagccagctccagggccccttgatatcgccctcgacttcggtctggcgctggtcgagccagaggatcgccggacgcaagggcttgccgtcggcatcgacgttgatcagcgtgccgcgctgggtcgtcagcgacacgccgcggatctgccggcgatcgatgccggtctgctgccacaactgctggcaggcctcgccgagtttgcgccagtagtaatcggggtcctgttcggcccagccgggctggctggaatagtaggcctgcaactcgaccttgcccttgcccagcaggttgccttgcaggtcgaacaacagggcccgcacgctctgggtgccattgtcgatcgccagcagatagggcttgtcgttgttcatggatggctcttggctaggcttcaataagcgacctcgggcaggctgtgataacgcagccacaggtcgtgataacgctgttgttcctgttcccagcgcgcgtcgtcccaaccgagcaggggctggcacagggcgcggatcgctggcagctcggccgccgcgccgttggccagcaacaggcccaggcgggcggcgcagcagcaggtcgtccaggtgcaggaccatctcgctttgggcggcaaacgccagctcggcccacaaggtgtcgctgctgccgacgcaagcgcatcccagctgcgccagccattgcgccagtcgcggcaggtcgcgcccatggcgcccggccaggcggcgcagctggccgctgctcaggcccgcgacctccgccgccggcacggccgcgaacaccgccgcgtcggcagcgtccagagggcgcccgagcatcgccgcacaggcctgcaacacctcgatggcctgggtacgaaaggtggtcagcttgcccccggccagcgtcacgcagcccggctcgcaccacagcgcatgctcgcgggtttcattggaaggcttgcccgccgcgtcggcgctgcccaccaccgggcgcaccccggaccaggtcgacagcacatcggcggcgccgatgcgcgcctcgggaaactgctgctcgcaggccgccagcagataggccagctcctcggcactgatgcgcgcgctctggtcgaggtcttcgcggtgatcgaggtcggtggtgccgaccacggtggcgccttcccagggaaacacgaacaccgggcgccgatcgctgtcatgcaggaagctgaatgcctgggccaccggcaggcgccagccgggcagcaacaggtggctgccgcgcaggggccgcaagtggcggttctcgccaggcggcgcgaaacgcccggcccaggccccgctcgccaccgccagcaccgcgcaacgcagggtcagcgactggccgctttccacgtcctcgaccgacaccccgcacactcgcccgtgctcgcgcagcacctgctgcacgcgcaggccattgaacgcctgggcgccatcggcccgcgcctcggccagcacccgcatcaccagccgggcatcgtcggtcagggcatcgagaaaacacgagccgcccagcaagccttcgaccttgatgccgggcgccaggtaacgcatttgctcgacgtcgtggaaacgatggttacgccgaccggccagggcgtcgtacaccgccagcaggccaccgaacacccgcggcccgggaaacacaccgcgatagtgcggcatcagaaagctcatgggctccaccagcccgggcgcttcgtcgagcaggcgctggcgttcgcgcaccgaatcgcgggtcaggcgccattggcccttggcgatgtagcgcaggccgccatggaccattttcgaggagcgactggaagtgccccaggcaaaatcgcgctgttccagcagcaggcagcgccagccacgccgcgccgcctcacgcaggatcccggccccgctgatgccgccgccgatcacgatcaggtcccagctctggcccgccagggtcggcagctgtgcctggcgccattgggcattccaatccgtgctcatgggccttattcctccagcagggtgccggggttgagacgcccggcagggtcgaagtgccggctgaggctgcgcagggcggcgatcgccagttcgcctttttcgtgtggcaggtagggcgcgtggtccttgcccacgccgtgctggtggctgatggtgccgccgtgctcgacgatggtctggctcgccgcatgcttgagcgccttccagcgggccagggtggccgggtagtccacggccgggcggaacacatagctggtgtagatgctcgagccttcgccatagacatgcgacaggtgggtgaagacatggacctgttcgccttcggccgccaggcaatcgcgcaggctggcctcgatgcgctgcaacaggttgtcgacattgctccagtcggtggcggtctccagggtgtcgaccacatagccggcatgccagaggctctcgcgcaggtagggaaaacgaaagcggttatgcgcccacttgttgcctagcaaggtgccggtgaacaccccgccgaaggccttcaggtgctgcctggcctggcgcagggacagggcgttctgctggcggttgccggtcacgccgaaggtcagcaggcacttgccctgccccgccccgcgcagcttcaggtatttctccagccaggcgatctgccgcggatggccggccagggccagctgggtctcggtttccaccgcgttcgacagccgcagcatggacagcggcacccgggcctgggccagttggcggatggcctgcagcgccttgggccagtccggcaggaacacgccatagaagcgctcgtcctcgaccagcgcgctgacccgcaccttgaccgtggaaatgatcccgaagcggccctcgcagcccagcaccacttcgcgcaggtccggccccgcggccgacgccgggaatgcgggaatctgcaaggggccggcgaaggtttccagggtgccaccggcgaacaactgctcgatgcgcccgtagcgcagggactgctggccgctggagcggctggcgacccagccgcccagggtcgacagctcccaggactgcgggaagtgccccagggtatagccgcgggcgcgcagctggctttccacctgcgggccgctggcgccggggccgaaggtggcgatcaggctgctttcgtccagctccagcaggcgattcatccgcgccatggacacggtcagtaccggccgcgtcgaaacgggcgggttgatgtggccggccaccgaggtgccgccgccgtaggggatcaggcacaggtcctgctgttcggccagggccagcagctggcgaacctgctcggcgctgtcgggaaaggccacgccgtccgggtagcgctccagcgtgccttcgcgcagggccagccagtccggcaggctctggccgcgggcatgcagcagccggtcaggggcctcgatgctgtacagcgcatggggcctcagccgcgacggcggcacccgggccaacgcggcttccagcgaagcatccgccagccggcgcccggtgccgatacgctgcgcaagaaaccctgcgccctgggcgggcaattcgaccaccgtgctttgttcgccccagccgttccagcgtcgcatgcctgtgccccttgtgtcgtgcttgtaagtgttggtttgcaaggcctccatactagttcgcggcgcacgggtgtcacggtcgcatcaggccagttcgagtagccaattgggtcagccggggacaaggggcccgaagcatttactttagtcccgctttcaaattacctttcagggcgccgacgcctgctggaacagcctcccactcggttcccgcgcgcgtccatccacgttccggcgccaggaaacccaccatgcacagcctcggctacacctcggtcccaccgctgctcaagtacctgcgctatgccgagcagctgggtatcgccatcgaacctgcgctggcggccgcgggcttgcaggccgggcaattgagcgacaacagcctgcgcctgcccggcgaggcccatgagcgtttgctggactatttctgcgagcattcggcagacccgttgttcgggctcaactcggcgcggttcgtactgcccaactcgtggaacgtgctgggctacatcaccatgaactgcgcgaccctgggcgacgcgatgaaccggatcatgccgttcgagaagctggtgggcgacatgggcgtcagccgcgccgagcaggtcgacgggcaaatacacttgacctggagctgccgccaccagcgccccacctcgcgccggcacatggtggagaacgtgctggcgtcgtggctgctgtacgcacagtggatcgccgatacccggttgagccccatcgccgtgtggttcgagcattcgctgccggcgggggccgagctggcccagtacgaggcattttttggcagcccggtgctgttcgaccaagcctattcggcgctgatcgcgcctgcgcaatacatgcagttgcccctgcgccaggccgacgcccagttgctgcgtaccctggaggaacatgccctgggcctgatggcctcgctaagcgatgcgccgctgccgcagcaggtgaaaaacgtcctgcgccagctgctcaaggaaggtctgccgcgcaaggagcaggtggcgaaacaactggccacctccgtgcgcaccctgcagcgccagctgcaacaggccggcaccggctaccagcagattctcgatgacctgcgccaggagctcgccgagcattacctgctgcacagcgatctggcgattcacgatatttcccagtacctgggctttaccgaacagcgctcctttcaccggaccttcaaaagccgcaccggcatgaccccgggagagtttcgccacagccagcgaacgcccacctccctgtagccgctgccgagcccgcgaggctgcgatcgaccccgcagggggcacaagcttcttgaggccgccggaggacctgcggtcctgtcgcagcctcgctgcgctcggcagcggctacaaggtccaggcgcaagatgcgaggtgctggctcagacgctgatggcgttggtaaataccagccgattgccgaacggatcgagcaccgtcaggtcctggctaccccagggcatggcctggatctgcgggtgggcgaagcggtaatccttggccagcaactgctgctggaaggcttccagctcgtcggtctcgatgcgcaacgcggagcccggcgtactgtcgccatggtggtccgacaggtgcagcacgcactccccacgcgacacctgcatgtacagcgggaagttgtcttcgaagcggtgctgccagtcgagcgtgaagccgaggaagtcgatataaaactcccgcgccttggcctcgtcgaagatccgcaggatgggggtggttctgccaaagctcattgcgcgactccctgatgaaagatgtccacggtatagcaggtggatgtcagcacttcggctaggccaaggctttctttaatatcatcaggccatcactgtgacggcgttcacctattcaacgccgcacgccttcagccgttgaacccttcgcgcaaatccccttgccgcgccaggaagcgcccttgccggcggccattggcctggccttcggcatagctgcacacgccgttgacccacaccccgtcgatcccctcggccgcctgttgcgggcttttgaagtcggccacatcgcggacccgcgccgggtcgaacagcaccaggtcggcccagtgcccttcgcggatttcgccacgctgcttgaggccgaagcgcgccgccgacagcccggtcatcttgtgcaccgcggtgtgcagcgggaacaggccgaggtcgcggctgaagtgcccgagcacccgcgggaaggcgccccacagccgtggatgggggaacgggtcttccggcaggccgtcggaaccgatcatcgacagcgggtgggcaagaatgcgccgcacatcggcttcgtccatgccgtagtacaccgcgccggccggttgcaggcgccgcgcggcctccagcagagtcgtgccccactcggcggcgatgtccatcaggtcgcggccgcccagttccgggtgcggggtggaccaggtgatggtgatgcgaaaggcatcggtgacctgcttgaggtcgagggtcgaggaactggccgcgtaggggtaacagtcgcagcccactggatggtctttcgccgccagctccagggacgccagcaattgcggactgcgcccccaattgcccgcccccgcgcatttgagatgggaaatgatcaccggcgccttggcctggcggccgatcaggaacgcctcgtccatggcctccagcaccggctcgaattcgctgcgcaggtgggtggtgtacaccgcgccgaaggcgctcagttccgcggccagttgcagcacctcgtcggtctcggccgagaaggcgctggcgtaggccaggcctgtggataagccgagggcgccgtcttccaggctggcccgcaactgctcgcgcatggcggcgatttcctcggtcgtggcggtgcgatacaggtcgtccaggtggttgctgcgcagcgccgtgtggccgatcagcgccgccacattgaccgccggctgcgcggcgtccaccgccgcgcggtagtcgcgaaaacgcgggtagacgaaggccgcctggctacccagcaggctcatcgggtccggtggctcgccgcgcagactcaccggcgaggcgctgatgccgcagttgccgacgatcaccgtggtcacgccctggctgagcttgggcagcatctgcggctggcggatcaccacggtgtcgtcgtgggtgtgcacatcgataaaaccgggggccagcacccgcccggcggcgtcgatttcttcgctggcgcgggcgccttgcaggtcgccgatgcgggcgatgcgaccctcgagcagggcgacatcggcggggtaagccgggcggtcgctgccgtcgatcaccagggcgttgcggatcagggtgtcgtagcgcatgtcagtctcccagcggcaggcaatcgtcgccgccgcggtaatcgtccagggccagtttgatccggcgcaggcgttcctggttgtcttcgggcagggccagcgccagctcggtggccagcacatcgatggccagcagcatgccgtagcgcgcggccgtgggtttgtagatgaaggaggtttcagcgttctgcagcggcagcagcacgtccgccagttccgccagcggcgagtcggccagggtgatggcgagcacgctggcgccgtagctgcgggccagttcgacggtctccagcaattcgggggtgatgccggtcagggagcaggcgatcagcgcgtgttgcgggcccagggccgcggcggtcacccgcatcatcaccgggtcgtggcaggcggcgatggggtagccgaggcgcaccaggcgcacctgcaattcgtcgctgcacaaggtagaacagccgcccatgccgaaggcgtgaatcatctgcgccttgcccagcaagcgcaccgcatcgcgaaagcgcgactcgtcgaaccccgccaggtgctggtgcagggtcgactcgatatcgccgacgatctgccggtagaaacccgactgctccggggtacccgctgggtcgagaaaacgcctgccgacgccgctggcctgggccagttgcaggcgcaggtcgcgcaggtcgcgacagcccacgctacgggcaaaccgcgacagggtggcggcgctgacttctgcctgctgcgccagctgttccaggctggccgaggcggcgaaaccgacgtcatcgagcatcaagcgcgcgatgcggccttcgccggcactgaaggaatcctggcgggaacggatctggtagaggatgtccatggacggcacctgggctcaaagcagttgggcaagaccgacggtcagggcgaaggcgaccaccgagatcagggtttccagcaccgtccaggtcttgaaggtctgggtcacggtcatattgaagtattccttgatcagccaaaagccgccgtcgttgacgtgggagaagatcaccgagccggcgccggtggccagcaccagcagttccgggtgcggataccccaggccgatggccaccggcgccaccacgcctgaggcggtggtcatggctacggtggccgagccggtggcgatgcgcatcaacgcggcgaacagccagcccatcagcagcggcgacagctggaattcatgggccaggccgacgatctggtcggtgaccccggcatccaccaggatccggttcaggccgccaccggcgcccaccagcagggtgatgctggcggtcggcgccaggcattcgttggtgaacctgaggatcgattcgcggttgaagccctgggccaggccgagggtccagaagctcaacagggtcgccagtaacagggcgatcaccgagttgccgataaacagcaggaactggttgaggccgctgcccggggtggaaatcaggttggcccagccgccgatcagcatcagcaccaccggcaacaggatggtggccatggtgatcgagaaactgggcaggcgggtgcgcggctcacgctcgatgaactggcgcgccagcgggttttccgccggcagctggatgcgcggcacgatgaatttggcgtacagggggccggcgatgatcgccgtgggaatgccgatcaggatcgcgtacagcagggtctgccccaccgacgcctggtaggcctgcaccgccagcatcgccgccgggtgcggcggcaccagggcatgcaccaccgacaggccggcgaccatcggcaggccgaccatcaggatcgacacgccgacacgcttcgccacggtgaaggcgatcggtaccagcaacacgaaaccgacctcgaagaacagcggcaggcccaccaggaaggcgatgcagaccatcgcccagtgcgcgttgcgctcgccgaaacggtcgatcaaggtccgcgccacctgctccgcgccgccggactcggccatcatcttgccgagcatggtgcccagcgccaccaccagggcaatgtgcccgagggtcttgccgacacccgcctcgtaggccccgaccacgccagacggcggcatcccggccatcagcgccaggcccaccgagaccagggtgatgacaatgaacggattgatccggtaacgcgcgatcaggacgatcagcgcgatgatggcgatggcggcatagcccagcagccagtagcccgatgcaggtgtcatgcggtactcctcgaaaaagggtcacgtcgaatgcttgtgaaactcataaatcatttcgtgacctgattttcaaaccacatgaaagtaactttcgcacagagacacgctctgtcgcggacagacaagtcgtgtcgcgaataatgaaaatcggcgaggggtattttcatccgctgtagcgcaaggagcagaaccccgcagccagtggccacggggaggaatagctttctgtaggagcgaagcttgctcgcgatcaggaccacgcggcgggtcaggcaggacgccatcgcgagcaagctcgctcctacagggacaggttatttgacgactttgcccacgccgcgcccgcgcgggtcggaggccgtttccagctggctgccggtgacccggatcgcctggatatcgcccatctcccaaccctggtcctccagggtgtagcccatggctttgagctcgtcggcgaccttgccggtgagcggcgcgtaggcgtcgtagtagatggtgtccttgggcagcaactggtgatgcacgcgctgcgcggccacggctttttccagcggcaggttgaagtcgtagaggttgttcagcacctggaagatcgaggtgaagatccgcgacccgcccggcgtgcccagcaccagggtgaccttgccgtcgcgggtcaccaggctcgggctcatggacgacagcatgcgcttgcccggcgcgatggcgttggcgtcgccgccgaccacgccaaaggcgttggctaccccgggcttggcgctgaagtcgtccatttcgtcgttgagcaggaagcccgcgcccttgaccaccacgccgctgccgtagtcccagttgagggtgtaggtattgctcaccgcgttgccgtcggcatcgacgatggagaagtgggtggtctggtgccgctccaggcccgggcggactttttcggtgggcgagatggccgtcgggttgatctcggcggcgcgttttttcaggtaggccgggtcggtcagctgcttgaccggcacctcggagaacgccgggtcgccaaggtaatcggcgcgatcggcgaacacgcgtttttcgatttccgccagcaggtggatgtacttggccgagttcagctcgacacccttgaagtccgccgtgcgttcttccttgatggtcatcagttgcgccagggcgacgccgccggagctgggcggcggcgcggtgtacagggtgttgccgcgccagttgacctgcagcggctcacgccaggcgaccttgtagtcctgcaggtcctgtttggtgatcaggcctttgtcggcctgcatctgcgccaccagcaggtcggcggtcttgccctcgtaaaactccttgacgccctggtcggcgatgcgttccagggtcgcggccagctccggctggcggaaggtttcgccgactttcatgctgccgaaatagtcgccgaaattggtgctgtccttgaacagcttcagcgcgtcttcgcggtactggtactgcttgtcggcgaccttgaaaccgtttttcgcatagcccaccgccggggtgatcagttcgctccagggcaacttgccgaacttcttgtgcgcctcccacaggcccatcaccgtgcccggcaccccggcggcgcgcgcaccgaccaggctgaggttctcgatcacctcgcctttgtcatccaggtacatgtcgcgggtcgcggccttgggcgcggtttcgcggtagtcgaggaagtagggtttgccgtcgatgaacagggtcatgaaaccgccgccgccaatgttgccggcctcggggtaggtcaccgccagggtgaaggcggtggcgaccgcggcatccaccgcgttgccgcccttcttgagaatctgcgccgcgacgtcggcgccatactggttcggcgcggcgaccgcgccaccttccagcaacgcggcgaaggtcggcgagctggcggcgatggccgctgtcagagccatggtcttaaacagaacaatgcgcataaggtccgtccttttattgttttttggcaggtcgaacgataggggcaagatcgggggcggagcaatcggcaaataaaaacggccgcttgaagcggccgtctggcgaggggacgagtgacggtggctacggtgccgcacttgaggtcgccacgaccgtaccggtcgatcgtccgaacgcgacccgagcctgcagcagcggctacaggatcacgctgcccgtgtagccgctgccgagcctgcgaggctgcgatcggcaacgcagttgccgcaaaacctgaatccgcgaactgcctggaaaaacgcgccagccggtttacgacggctacgccgccgagcgcaggctcgacagcggctacagggatagcgggtcagaccatctcgtggcgaatccactccagcaccgaggtgcgccgcggtacccagcccagcaattcgcgggcgttcttgccccgcacgcggctgttggagcccaggccgtagttggccatttcatagccccattcggcttcggcctgggccagcggccagtcctgcggcgcgccgaggtgcagggcctgggccatggcggtggtcatgtcgatgaaggaggcttcagcgctttcgacgaagtagaaggtgcccgggatgttgcgggtcagcgccagcaggtacagcgccaccacgtcttcgatatgcacgttggaccagatgttctgccccggcccgacatgccgcaccacgccactgttgcgcgcctgcttgagcagccgcggcagctgcacgctgtcgcgtttcacgccgaggctgtggccgtagatcagggtgttgcagagcaccgccgagttcaccccgtccttggccgcggccagcaccaggttgtcgatggccacgcgcgcggccttgtcgacggtgggctctggcaggttgttctcctgatagacgacgtcgctgactttgccgcccgaagcgtcgccgacgatgctcgaaccgctggtgtgcaagaagactttattggaccccttgagggccgcgagcaggacttccaccgctccacgatggtcgctgctggccgcgttgatcaccgcgtcggcggcacgggcctgctcggtcagcacggcgctgtcgtccaggctgccgagtaccggctggatgcccagggcgctgagttcggcggcctgttcggcgctgcgcaccaggccggtgacttgatggccggcccggaccaggccggtggcgatggagccgccgataaaacccgcggcgccggtaacgaatacattcatggagaaactccctgggtggataagtgatggcgccagtatcgacgggcgactcctgccgaaacaggcagcttggcccaaatcactcttgcgtagggatcacgaatcagggatcggtcttcccacggagattgaccgctgcaggagccggcttgccagcgatggcgcctgcccgggcggtgcaaggcgcaccggttcctacagcagaaaggcctcagccttcgaacagcgggttggcgtactcggccagcttgccctggataaagtcgaggaagcactggatgcgcagggccagctgcgagttgcggtagtacacggcgttgatcggctggcgatagccgctgttgaactgggcgaggagcggcgtgaggcgcccggcgcggatgtcgtcgatggtcatgaagtgcgacaggcaggcgatgccctgccctgccagcgccaggtggcgcaccgtctcgccactggaggcgctgatgcccggctggatcggccagcggtcgccgtgcacatggcgcagcggccagtggttgagggtttcggtctgggtgaagcccaacagggtatggtcgctcagctcggccacgctggcgggtgtgccgtgccgcttcaggtagtcagggctggcgaggatgtgtagcgggctgcaaccgagcgaacgcgcgtgcagggtcgagtccgccagggtgccgatgcgaatcgcgatatcggtgctctgttccagcaggtcgatgatcaggtcgttgctgttgagctccagctggatgtccgggtacaggcttcggaactcggcgatgtagggcacgatggcatgcagcatgaacggcgaggcggcgttgatgcgcaggcgcccggacggcgtctgctggcgggacgacaggcgctcttcgagttcgtccatctggtcgaggatcagcttggcctgctcgaagaagtacttgccctcttcggtcaggtccatgcgccgcgtggtgcggttgatcagcgtggtatcgagcttggcttccaggcgcgacagggtgcggctgaccgccgacggcgtctgcccgacctgctcggccgccgcggaaatcgaaccgcactcgatgacgcagacgaagatctggagttcgtcggatctggctttcacgtaagtcctctatctcggttgggcacctgtagccgctgccgcaggctgcgatcgaccgcgaagcgggcgccgctcttggggccctcgaaggtcctgcggaccttatcgcagccttcggcagcggctacagatcctgcatcaggtgcgcaggacgccaccgatagtagccggatttacgcggggaggttgaacaccgccttgaggtgttcttcgtagcgctgcacatcggcctcgatgttcgggcgtttcatcacgtcgacgcagaggaaggtcggcaggccgcgcatgccgaggaactggttggccttgtggaacgggaagtacaccgcgtccacgcccttggcttcgaagaagtcggtggggtcgtcgaaagcttgctgcggagcgttccaggtcagcgacagcatgtactgcttgtcgtggatcaggccaccgctgccgtacttctgcgaggcatcggaacgggtgcggccgtcgctggcgtagaggctgccgtggccctcggtgaagacttcatcgatgtactttttcacgatccacggcgcgcccatccaccagcccggcatctggtagacgatcacgtcggcccagaggaacttggccacttcttcctggatgtcgtagccctcgtcgatgtgggtgactttgacgtccacgccgccacggtccagcaccatcaccgcggcttcatgcagggtcgcgttgtagcggccgtcggagtgggcgaacttcttgccaccgttgagcaacagtacttttttcatgatccagcctcatcaggaacaaccctttggcgctgcgccgcagggccgggtcgagaagattaaaaaacgatggggcggagaatatcgttgaaagacgatatgaataagcgcgatccaggcaaaaagcatttgaccaatacgcacgaataggcggcggattcgtgtcgtagaatttttaaaactccctttacctaggaacgcagcatgtccgaacagcacggttttatcctccacgccaagacccgcccggaaatgtccgaggccttcgaggcgctgtttcgcgcctatgtcgaacccagccgcgccgaacccggctgcatcgaataccacatgctgcgcgaccagcaggacccgagcctgttcatcttctatgagatctgggaatcccaggcgcacctggacgtgcactccaacctgccgcacatgaaggcgttcttcgacaagcgcatggattacctggaacgcgacttcgatatccgccgcatcgacatgctcagcccgtcgtccgctagccgttgatcaataggtgggtaccaagcacccccaggccgctgaagaacacccgcttgaacaacaccgcgctgatgcgctggcgcagtgcctggcccagccacatgccgagcagggccgggatcagcgccagcagtgaggcgctgagttcgccgccgcccagggcgccgcgccagtacaggccggccgccagggccagggtcgagacggtgaacgacagccccagggcctgcaccagttcgtccttgtgcagccccaagacctgtagataaggcaccgccggaatcacgaacaccccggtggccgaggtgatgacgcccgtcaccaggccacaggccgggcccagccagctttccattcgcggccgcagccgcagggttggcagcagcaacccgctcagggcatagagcaataacgccgcccccagcgcccgcaccacccaatgtccaccgtcgatgcccagccacaggctgcccaggcccgtgccgataaaaatcgccagcagcagcggccacaagcgcttgagcaacgtccatagatgcccgccgaacgccagctgccagacattggtcagggtcgccggaatgatcaacagggccgcagcctgcgtcggcgccatagccaggccgagcaggcccatggcgatggtcggcaggccgaggccgatcacgcccttgatcatgccggccaggacaaaggtaccgatcaccagcagggacaggagcaaaccgaggttctggtaaaacgcgagggaagtgttcatggcgctatcctgcgcccgcggcggtgggctgaaaatctgccatatactgaggcagcctcttgtctggcgagaggctttggattttcagcggctgtgatgaccctatcgcgagcaagctcgctcctacatcgaagggtgttgcccctgtaggagcgagcttgctcgcgatagccgcacagcggcgctatcaaggacaccctcatgcacttcgacctgaccgacctgcgcctgtacctgaacatcctcgacgccggcaatatcaccgccggcgccagtcgcagccatttgtccctggccgcggccagcgcacgaatccgcgccatggaggcatccctgggcaccgagttcctgcagcgcggccgccgaggcgtgaccccgacgcccgccggcaaggccctggcccagcacgcgcgcggcctgctgcaacaggccgagcacctgcgccaggatctggccgaatatgcccggggcgtcaaaggccaggtgcgcctgttgtgcaataccacggcgatcaccgaatacctgccggagccgctggcggactttctctgcgcccaccccaacctcgacatcgacctgcaggaactgcccagcctgcgcatcacccacgccctgcgccagggcgcggcggacctggggatagtctccgacgcggtggatacccaggacctgcagaccctggcgtttcgtgacgacccgctggtactggtcctgcctgcccaccacccgctggcggacggccgggcggtgagtttcagcgacagcctgcaccacgactatgtcggcctcgccgcccacagcgccctggccgtgtacctggaagaacaggccttgcacctggggctgcgaatgccgatccgcatccgcgccgacggcttcgacggagtcatgcgcatggtcgcccggggcgccgggctggcggtggtgccccgggccgccgtcgaacgccgggggccggatgcatcgctcaacgtgctgccgctggtggaggcctgggcgcaacgcaagctgctgctctgcgcccgcgacttcaacgccctgccgccctacgccaaggctctcctggaaaccctgagccccttgtaggagccgccggtcgacgctcgattgctcgcgatccgcacagcggccatgcacggtggcgactcggcggacgctatcgcgagcaagctcgctcctacagtgtttttggctcagaccttggacaacgcccctgccggcgcccgggatttcctgaagaacagccagtacgccagggtcaggatcagcaggaacggcacgccgaacaccagggtcatcttgaaggcctcggtgaagtaggtggtgatcatcaccgcgcccatcagcaccaggcccagcaacgtgctccaggggaacaagcgcatgtggaacgacagctgttgctcgccatggcgctggtggtaacggcggaagcagtagtgcgtgaggaagatcatgaaccaggtgaagatcgcgccgaacatcgagatcgccatcatcagagtgaacgagctttccgggtacagcacgttgatcagggtcgccaggccaatgcccgagctggacagcagcaaggcgttcaacgggatgccgctcttgctcagggcgcccatggacttgggcgcataaccgccgcgggacaggctgaacatcatgcgcgtggtgatgtacagctggctgttcatcgccgacagcgcggcaatcaggatcacgaagttcatcacaccggtggcgccgggaatgccgatggtctgcatcaccgtgacgaacgggctctgcgccttgccggcctggacccagggcacgatggccagcatcagcgccagggtcagcaggtagaacaccaccagccgcaccatggtcgcgcgaaaggcctttttcaccgcccgctgcgggtcctcggcttcgccggcggccaccgcgatcatctccacgctcaggtagctgaagatcgaaacgatcaccgcgatccacatgccctgcacaccgtgggggaaaaagccgccgtgggcggtgtaattgtgcaggccgtagtcggcattgccggagccgaacaccacgtacaccgcgaggatgatgaaaccgacaatggcggcgatcttgatggtggagaaccagtactcgaagttaccgaaggttttcacgctgatggcgttgagcaggatcagcacgctggagaacgagacgatccacacccattccggcacgtgggcgaaccagtacttcatgtacatggcgatggccgtgacctcggcgccgaccgccagcacgatggccgcccaataggcatagcgcaccaggaacccggccagcgggctgatgtagaactcggcgtaggcgccgaaggagccggaggtggaatgggccacggtcatttccgccaggcagcccatcagcagcagggtgatgaccgcgccgatggcgtagctgagcagcacgctgggcccggcgtaaccgatggcgtaggcactgcccatgaacaggccggtaccgatcgccccgccgatggcgatcatgctcatctgcccggccgtgagctggcgcctgaggccatgctcacgcttggatatggcttcaaagccggtgttatcgttcatgtttctgtcctctgaatattgtctttcttgaagagagcacatcgttggggtgatgcctggggccgtcatatgcggcagcgaatggatcagaaaatactcagcggatattcgataatgagtcgaacttcattgttgtcggtggtatccgctcgagccacctggctggttgaacgcagcgagccctggcgcactcgcagcgacaggtccttggccttgccggactgcacgatgtagcgcgcttcaatgtcccgttcccagcgctttccgtcgctaccgtaacggccataggcgccattgacgccaccgtcatagtggctgtcgtcgatatgatcgccgctgacataccgcgacatgaaactcagccccggcacaccgaaaggcgccatgtccaagtcatatcgcagttgccaggaacgttcgttgggtgcgttgaaatcaacgatctgtattgagttggcgagaaaaatcgaggtgcccggctgctgatcgaaacccagataatcgaacggctcatcgccatcgacgcgttgataggccagggtcaagcgatgtgcgccgaccttgtaggaaccggccagcgaccaggtggtattgtcgatcttcccggccaggctctggccggtgtcgttggtgcggtagatattgaagtcaaggttcagcgactggcttgcgctgactgggtaggtgtagctggcattggcatagtactgccgccagatatcggtgaactgcgagccgtacaggctgacgcttaactggtcgttcaggctatagacgccacccaggtaatcgacgctgcgggtttccacgccggcatacaaggctttgagggcgccgttgtcattggtcgatgcactgtcgttgcctgaagtgaagtgcccggcgtcgagcagcaggccgttcaattcgctgctggtcagttgaaagccgttagcctgttgggtgaacagtcgcgcgttgcccgtgccgaacaccgggttgagcggtgtcaggttgccgtatttgagttcggttttcgagatccgcatcttgagcgcaccgcccgcttcggagtattcatcctcggcgcgaccgtcggagtcgagtggcaacaaacccgtaccgctacgccccttgccgctgtcgagtttaatccccacctgcgcgaaggcgtcgatgccgaagcccacggttccctgggtatagccggatcggtaatccagcaggaccccatgagcccactcgttccgataattctgggcgccggggttgttgaggttgttgcgatagaaatagaagttgcggttagtcagggtcaggctgctgtcttcgacgaatccatggtcggaggcggcatacgccagttggccgagacaggtactgatggcaagcggcaaggctgaccagaggggcggcttcattctgcatgttccttattattatgttttctcagaacgctttattggaggcgaccgaagccccgccgccgaaaaaatcgccacggcaggacaacgaggccaggggtatcaggtgacgctgtggcgcacctggaactgcgcttgggaccaggttttctggtcgaggatttcaccgaggatctgcaccgcgtcccagacttcgctgaagcgggtgtacagcggcgtgaagccgaagcgcatgatccgcggttcgcggtagtcgccgatcacgccccgggcgatcagggcctggatcaccgcataaccttcggggtgttcgaagctgacatggctgccgcgcttgtcgtgttcgcgcggggtgaccagcttcaggccatgggccgcgcagcgctgttccaccagttcgatgaacaggtcggtcaaggccaaagacttgcgccgcaggctggccatgtcggtctgctcgaagatctccaggccgcactcgaccatggccagcgacgtgatcggctgggtgccgcacaggtagcgggcgatgccgctgctcggctggtattgcgcttccatgtcgaactgccgcgcatggccgaaccagccggccaacggttgcctgaccaggtcgcagacggccggcgagacccaggcgaaggcttgcgagcccgggccgccgttgaggtatttgtaggtgcagccgatggcgtagtcggcgccggcctgcttcaggtccaccggcaccgcgccggcggagtgggccaggtcccacaggctcagcgcgccgcattcgtgggtcagcgcggtcaccgcctgcatgtcgtgcatgtagccggtcttgtagttgacgtgggtcagcatgaccaccgcggtgtcttcgccaatggcctggggcaactcctcggggctgtccaccaggcgcagggaatagccctgctgcagcatctcggtcaggccttcggcgatgtacaggtcgctgggaaagttgctgctctcgctgacgatcacccgccgctgcggcgccttgagcgcctgcacccgcaaggcggcgctgagcaccttgaacaggttgatcgaagtggtgtcggtgatcaccacttcgttggcatcggcgccgatcagtttggccaggcggtcgcccaggcgctgcgacaggtcgcgccagccggcagtgttccagctgcggatcaggccattgccccattcctcggcaatcacctgttgcgcccgttgcagggccgcgaccgggcgggcgccgagggagttgccgtcgagatagatcaccccgtcgggcagcgcgaaccggttgcgcagcggtgccagcgggtcctgtgcatcgagggccaggcagtggtttcttgttgtcatgggaagtcctgtttttcactaaggcatgcggcggcacacgccatgccaggggcggcatcggcggctgcacggtgaagaaataatgaacgaagccctggagaattttcgtgcaaaatgcgctatgagagcggcatagtctcgaagattattcgactacaacttaaaaaaacgcggataaatgccaaccatgattctcgactctacagacctgcgaatcctgcacttcctgcaacaggacggccgtatcagcaaccaggagctggcggagaaagtcgccctctcgccctcggcctgcctgcgtcgcctgcgcctgctggagggcgaaggcatcatcagcggctatcgcgcggtactgaatgccgagcgtttggggatcgagttggaggccatcgttcatgtgtcgctgcgccaggacgtggcggactggcacgagacctttatcaagaaggtccagcagtggccggaagtggtgaccgcctatgtggtcaccggcgccagcaactatgtgctgcgggtccaggcgcgcaacctcaagcatttctcggatttcatcgtcaatcacctgaaccgcacgtccggggtcaccgacatccgctcggaaatcgtcctgcagaaaatcaaggaacaggacggcctgctggacctggtgctgcgcaagtaggcttgcctagaaaccacccaggcgccgcgcgtcgtggcgctgcagggtgacgctgggcgactcgccgaacagcttgcggtattcggcggagaaccgccccagatggctgaagccccagcccagggcgatctcggaaatggtccgcgccgagccgtgttcgaggatctcctggcgcaccgcgttgagccggtacttcttcaggtagaccatcggcgacagggcaaaatacttcttgaaggcctcgaacagcttgaagcgcgagacccgggcggcggcttccaggtcttccaggcccagcggttcgcgggcgttggcgtgaatgtactggcgggcgcggaccaggtagtggggcaacttgacctccagcacctcgcgcagctccgccgagtagttgttcggctgggccaggatcaggcccttgatcaaggagctttccaggtcccgggtgaaggccagctgttcgtacagctcgctgctgcgctccagctcggcgatgaaatagcgcgccatgcgccaccaggacgccgatgccccctccaccgcatccatcaccgcctcgaagcgcagcggcgcttgcggcgggcgttgcagcaaggcttcgagggcctcgctcatggccgcccgggtaatcaccacttggactttgcggcagtcaccggagatcgccagcatctggctttcattgggcgcgatgatcaccccctggtcgcggttggaacgcagcagccggccgtccttgctcagttcctgatcgccgctcagcggcaggctcaggctgtagctgctgaagcgctcggcgtcttcgatatcgatggtgacgtcggtgccgtattcgatggtgcccagggtcgtggcccgcgacttgaacacgttggcgctgtggtgaaagcggatgcgctcgggggtgctggtttcgagccgatgcggcccgcaaatgccagacatccagcttctcgccccctcgaggtcgtaacgatcgatacgaatatcgcgaaactgcgaatcagccttgctattcatcacggcgcacccacggcaatattttttttgcgcgctctgacggcgcgtctgatttgaagtactgacctgcaagagcaagttttgcgccaccgcccggcactgccaaccgactggatagcaatcgccgactaagtggatagaacccgtccacccggtgcgcaaaacccacgcaagactgcgccaaacagtagctcatcgcgacatcgcggtgcagccgttgatcgcctgccacccaggccctgggtatttccaccacacccgaacgccgcccccgtagccgctgccgcaggctgcgatcgacgacgcagtcgtcgcaagacctgagcccgcgatcctcctgaaacaccgcaatacccggtttgcgcctgctgcgcccgaacgcggaccgagccgatcgcagcctgcggcagcggctacagatgagcgtggccatgcaattttgtggatggccttggccgactaagcggatagccacccctgccccgcactctctctaatgcatgcaccgattggcctgaacaagaaaggtactcactcatgagtggtgcaagaaacacagaacaatggaaaagcttcatcgacggctgcctggattttcgtccggacgacggcgtattccgcatcgcccgggacatgttcaccgagcccgagctgttcgacctggagatggaactgatcttcgagaagaactggatctacgcctgccacgaaagcgagctggccaacaaccacgacttcgtcaccatgcgcgccgggcgccagccaatgatcatcacccgcgacggcgaaggccggctcaacgcgctgatcaacgcctgccagcaccgcggcaccaccctgacccggctcggcaagggcaaccagtccaccttcacctgtccgttccacgcctggtgctacaagagcgacgggcgcctggtgaaggtcaaggcgccgggggaataccccgaaggcttcgacaaggccacccgcggcctgaagaaggcccgcatcgacagctacaagggcttcgtcttcatcagcctcgacgtccacgccgacaactccctggaggacttcctcggcgacgccaaggtgttcttcgacatgatggtcgcccagtcgcccaccggtgaactggaagtcctgcccggcaagtccgcctacacctacgacggcaactggaaactgcagaacgagaacggcctcgacggttatcacgtgagcaccgtgcactacaactacgtggccacggtgcagcaccgccagcaggtcaacagcgagaacggcggcgccagcgccaccctcgactacagcaagctcggcgccggcgacgccaacaccgacgacggctggttcgccttcaacaacggccacagcgtgctgttcagcgacatgcccaaccctgcggtgcgctccggctacgccaccatcatgccgcggctggtggaagagtacggccaggaaaaggccgagtggatgatgcaccgcctgcgcaacctcaacgtctacccgagcctgttcttcctcgaccagatcagctcgcagctgcggatcatccgcccgctggcctggaacaagaccgagatcatcagccagtgcatcggggtcaagggcgagtccgacgccgaccgggaaaaccgcatccgccagttcgaggacttcttcaacgtctcgggcatgggcacccccgacgacctggtggaattccgcgaagcccagcgcggtttccagggccgcctggaacgctggagcgacatctcccgcggcagccaccgctgggcaaccgggccgacccgcaacagcgaagccatcggcatccagccggccatgaccggcaccgaattcacccacgaagggctgtacgtcaaccagcaccgcaactggcagagattcctcctcgacgggctggcccggcaatccctgaaactgcgtgaggtgtgaacatgagtgcgcaactgcaataccgtatcgagcagtttttctaccgcaagtccgagctgtgcgacgcccaggactgggatgcctacctcgaactcttcgacccgcagagcgagttccacctgccgcagtgggactccgagcatgtctacaccaccgacccgaaacgcggcatgtcgctgatctactacgccaaccgctcgggcctggaagaccgggtgttccgcctgcgtaccggtaaggccgcctcgaccattccgatgccgcgcaccctgcacaacatcagcaacgtgcgaatcgccgagctggccgacggcagcctgcaagtgcggctgaactggcacacgctgttctatcgcctggccaccgccgagcagttcttcggccatgccacctacagcctcaaggcccacggcgacagctggctgatcacccgcaagcatgtgctgctgctcaacgacaccatcaactcggtgctcgatttctaccacctctgacggagaccgggcatgaaccacaaggtcgcgttcagctttgccgacggcaagacgctgttcttccctgtaaacgccaatgaaatactgctcgacgccgccctgcgcaacggcatcaagattcccctcgactgccgcgagggcgtctgcggcacctgccagggccgctgcgaatcgggcacctacagccaggactacgtggacgaggaagccctctccagcgccgacctggagcagcgcaagatgctcagttgccagacccgggtgcagtccgatgccaccttctacttcgacttcgattccagcctgtgcagcgccgcggggcccgcacagctcggcgccacagtcagcgcagtgcgccaggtctccgacagcacggcgatcctgcaactgcagctcgacgagggtcaggcggcgctggacttcctgccggggcaatacgcccggctgtcggtccccggtacgtcgagcaaacgctcctactcgttcgccaaccgttcgggcagccagcagctgcaattcctcttgcgcctgctgcccgacggggcgatgagcaattacatccgcgaacgctgccaggtcggcgaccgcatcgagctggaggcgcccttgggcgccttctacctgcgccatatcgtccggccgctggtgctggtggccggcggcaccgggctgtcggcgctgctggcgatgctcgagcaactggtcgccgacggctgcacccagccggtgcacctgtactacggggtgcgcaacgtcgccgacctgtgcgaaaccgcgcgtatcgaggcctatgccggccaactgccgggctttcgctacactccggtgatcagcgagccgacggcggactggccgggcaagcgcggttatatcgccgagcatttcgactgcagcgaactgcgcgatgctccggtggacatgtacgtctgcggaccgccaccgatggtcgagtcgatcaggaactggttgcaagatcagcaacttgagagcgttcagctgtattacgagaagttcaccgagagtaatatctgatccgtccgccgtcagccgcgatctggccgcgaatacggacagatccgataacaatgagaagagagcgtgattagtggatgagatcctgaaacccggcgaactcaagcgtggcttgaagaaccgccatatccagctgattgccctgggcggggcgatcggcaccggactgttcctaggctccgccggcgtgctcaagtccgccggcccttcgatgatcctcggttatgcgatagccgggttcatcgccttcctgatcatgcgccagctcggcgaaatgatcgtcgaggaaccggtggccgggtccttcagccacttcgcgcacaaatactggggcggttacttcggctttctcgccggctggaactattgggtgctgtacgtgctggtgggcatggccgaactcacggccgtgggcaagtacgtgcagttctggtggccggaaatcccgtcctgggtcagcgcggcggtgttcttcgtgctggtcaacctgatcaacatgatgaacgtgaagttcttcggcgaagccgagttctggttcgccatcatcaaggtggtggccatcatcggcatgatcgccctgggctgctacatgctggccagcggcagcggcggcccgcaggcggcggtgagcaacctgtggagccacggcgggttcttccccaatggcggcaccggcctgctgatggccatggccttcatcatgttctccttcggcggcctggaattggtgggcatcaccgccgccgaggccagcgagccacgcaaggtaatccccaaggcgatcaaccaggtggtgtaccgggtgctgatcttctacgtcggcgccctcaccgtgctgctgtcgctgtacccctgggaccagttgctgcagaccctcaacgcttccggcgactcctacagcggcagcccgttcgtgcagatctttgccctgatcggcagcgacaccgcggcgcacatcctcaacttcgtggtcctgaccgcggcgctctcggtgtacaacagcggcgtgtactgcaacagccgcatgctctacggcctggccgaacagggcgacgcgcccagggcgatgatgaagctgaacaagcagggcgtgccattgctggccctgggcgtctcggcgctgatcaccctgctctgcgtggtggtcaactacctggcgccgcaggaagcgctggaactgctgatggcgctggtcgtcgcgtccctgatgatcaactgggcgctgatcagcctgacccacctgaagttccgcaagtccatgggccagcaaggcatagtgccgtcgttcaagaccttctggtttccgttcagcaactacctgtgcctggccttcatgctgatgatcgtcagcgtgatgctgatgattcccggcatccgggtgtcggtctacgccatcccggtgtgggttgcgctgatctgggtgttctaccgcctgcgcgtggccaggtccggcgctcgcgcggtggcctgacaacggcagcacctgccccggtagccgctgccgagcccgcgaggctgcgatcgggcgcgcagcggccgcaaaacaggcgaccgggttcaacctgccccaccgcagtgaccggttttacggcgcctgtggagccgatcgcaggcggcgccagcggctacagaaaacgaggaaatcttgtagccgctgccgagccccgcgaggctgcgatcgggcgcgcagcggccgcaaaacaggcgaccgtgttcagcctgtcccaccgcagtgaccggttttacggcgccagcggctacagaaaacgaggaaaccttgtagccgctgccgagcccgcgaggctgcgatcgggcgcgcagcggccgcaaaacaggcgaccgtgttcagcctgtcccaccgcagtgaccggttttgcggcgcctgcggagccgatcgcaggctgcgccagcggctacagaaaacgaggaaatcttgtagccgctgccgagccccgcgaggctgcgatcgggcgcgcagcggccgcaaaacaggcgaccgggttcagcctgtccaccgcagtggccggttttacggcgcctgcggagccgatcgcaggctgcgccagcggctacagctcggcataaataaaaaggcccggcattcgatgaatgccgggcctttttgttggcttgccgcttacagcgtcgaacgtacgcgccacagctcggggaacagtacggtgtcgagcatcttgcgcaggtaaccgacgccttcggtgccgccggtgccgggctggaagccgatgatgcgttccaccgtggtcacatggcggaagcgccactggcggaaggagtcttccaggtcgatgaatttctccgccaactggtacagatcccagtagcgcgacgggtcggtgtagacctcgcgccaggccgcttccaccgacgggtcatgctgggtcggcgcctggctgttcagggccaggcgctcggggtcgatggccagcccggccttggccatcaggccgatggcttcgtcgtacagcgacggcgtggcgatcgccagctccagttccttgagcagttccggacggtgggcatgggggcgcagcagggtcgcgctcttgttgccgaggatgaactcgatctcgcggtactggaacgactggaaacccgacgagtgccccaggtacgggcggatcgacttgtactcggacggggtcatggtcgccagcaccgcccaggcgtgcaccagctggtcgaagatccgcgacacccgcgccagcatcttgaacgccggtggcagctgcccctgatgcacgtgctcgcgagccgccttgagctcgtgcagcatcagtttcatccacagctccgaagtctggtgctggatgatgaagagcatttcgttgtggtccggcgacgaggggtgctgggcattgaggatgcgtcccaggtccaggtagtcgccgtagctcatggagttggaaaaattcagctcggcgttatgccagttgtcgggcggcgggttgttcgaatagggacattgactcatcgcgtgggctcctcatgtcaggtcgcggccgggcgatcacccggcgccggccttgatcgagggcgcgcggggtcgaagcttcgttgttgtaaatactattgtaggaattatcgcggcaaaggccgcaggatggcgcgcaccgggctcgcatccagatgagcgaaacgcaggggcagcgcgatcagttcgtagtcgccttcggccacctcatcgagcacgatgccctcgagaatcgccaggccatggcgggccacggcgttatgggcgtccatggttttcgattgctgcgggtcgagggacggggtgtcgatgccgatcaggcgcacgccgtggctggccagcagctcgacggtctccttggccacggcgctgaagtccgggtcccaggtgctcaacggcgcctgtcgataggtacgcagcagcacccgctcgggcaggttgtccaggtgcccctccaggtgccggggcaataccagcggcccgcaacccaggcaatgcacgacccggcacgggccgaggtagacatccagcggcacctcgccgatcggcgcgccatcggcgctgtagtgcagcggcgcgtcgacatgggcaccggtgtgcggcgacagggtgatgcgcccgacgttcaccgggcattcgggcccgtattgccagacccgctcttcctggaacggcgtatcgccgggccaggtcggggtcgcggtactcaggggcgggctgatgtcccaccagcttggggttgtgctcatagcgctgctctcggccatttcgacctgaatcatacgagcgatgcccgtgaagattcttgtgaaatactccggcgaccgcagaatctttcgcatgaactgccaggaaatcactgattctcgctcggaaatttcaatgcaaaccgcggcaacacttcacgggcgggtactgcgtttctgggcaccccgatgtcgagtacagacaactggccgggtgccgggcgctatagggtgcgacttcagttctcagccaacgccccggagtcctcatgaccgcgactgcccccatcaccgttctgcgcgacacccacccgctgccggttctcgatgcctgcaaatgggaaaagctcgaaggcgacccgcacaccgtcaacctcaacgcctacaccagcgaagacggcagtaagatcatgggtacctggatctgcactcccggcaaatggcgcgtggactacgtgaaatgggagtactgccatttccaggaaggctactgcgtgatcaccccggacggcatggacccgatccacctgcgcgccggcgatatcttcgtggtcgagccggggatgaaaggcacctgggaagtggtcgagaccgtgcgcaagtatttcgtgttcgcctgacgcccgaaaatgcgggccgcagttttgcaaactgtctgatcggcccggcgaagaactttccgcgaaacatcaagaggcgctcatatcattgaggagcgcctctttttataaagtcacagcaataaggcagacgccccgccatacacttcccggcctaatgatattggccaaccagaagttcacccatctcaccccagcgaatacagacagcccatttaaacttccagcaagcttgcttaaacaaaaaaaccaagcagacaacccgcatttaaaattttagaaagtctattaatacaacgactaaaaaggggacgatttcaacgtccccttttgcacattaaagtgcttgatggtgatgcacctgacacttaatcgttggctttcgagattttccatgagccggtattgccgtcccgattcagatagggggtcgtcgataccgcatatttgacgccctcgccactggcatgcccacaggtgtccaggaacccgccgcgcacatcgttgtagccattcaggaagtgcacgacatccccctctctcaccttgaaatccttgggatctgaggtatcggcgaaaattcgccagtgcagggtatccgccggccgcgattccttgagggccgtgaccacgttgtagatcgacggttttgttgcgtggccattggtgtccagatagccaccctcgttgttgtagaggttccacagcagaatcacatcgcaactttcaacctcggttcctactgccttgcctgtcgcggactcgatgatccaggtgccagtacccgggccgcgatgaggagtggttgcggtgactacgccgtaaaggctgttcggggcggtggcatgattacaagtatcgagataaccgccatcccaattattgtaaccattcttgatatgaactttgtctccgtatctcaggacatctgccatggtctatctccctgataaaacctcatatacatgccatatccatgacatgtcgtcattcgacagagacgctgtcgacacaagtcaccttagctatcaatcccgatactgccagagcatgccttatacattgtcgcgataaagctacttgcgaatcttcatcgcctgccttgccaatattacggacgatattcgaccgtaaagaacggtcataaaccgatgtgatttttctgtacaagcgcgattgccgaggacggcgcactcgatcccggcccgtgccagcggctacaggggagcgaggtccattgaggtaagagagatggcaaaaaaccgggagcccgcccgacgcgggctcccggaaaaacccctattggggcttgcgatagctgttgacgatagccgagaagtccatgcccccttccccgcgctggctcatggcctggtacagctgctgcgccacggcgcccagcaccaccggctggtgcgcctggcgggcggcctcggtggccaggcccaggtccttgagcatcagctcggcgccgaagccgccggtgtagccacgggcggccggcgcggtttcgatcacgccgggccaggggttgtaagtgtcggaactccagcaacgcccggtggagctgttgatgatgcccgccagcaccttggtgtcgatccccagggcatcgcccagggccatggcttcgctgacaccgatcatcgagatgcccagcagcaggttgttgcagatcttggcgatctgcccggtgcccacttcaccgcagtgcacgatattgcggcccatctgcgccagcaccggctgcagggtggcgaacagttcggcgctggcgccgaccatgaaggtcagggtgcccgccgccgcgccgccggtaccgccggataccggcgcatcggccacagtcacgccttgcttggcggctgccgcggccacgtcgcgggcggtctgcgggtcgatggtgctgcaatccaccgccggcgtgccacgggcgatacccgccagcaccccgtcgtcccccagccagacgctgcgcacatggggcgcggccggcagcatggtgatcaccagctcgctgtctgcggcggcggcgcgcggcgaggtactgatgctgccacccagttcggccagctccttgagcacggcctggttcaggtcgaacaggttcaactgatgcccggccttgagcaggttgcgcgccatgggtgcgcccatgttgcccagaccgatgaatgcgattttcatgagcggactcctcaacgcaaatggatggtggtgttcacgccatcgttgacgctgtcatcgtcgaaccagcgactggtgacggtcttggtctgggtatagaactgcaccacttgtttgccatagggccccagatcgcccagtttggaaccacgggaaccggtgaagctgaagaacggtacaggcaccgggatcgggatgttgatcccgacctggccgacatcgatttcagtctggaacttgcgcgccgccgcgccgctctgggtgaacaggccggtgccgttgccgaaggggttgctgttgaccagggcgatggcctggtcgagggtgtccacttccagcaccaccagcaccgggccgaagatttcctgggtgtagatctgcatgtcggtggtcaccccggagaacagggtcgggccgacgaagttgccctgctcgaaacctggcaccttgacgtcgcggccgtccagctccagcttggcgccttccttgatgccgctttcgatcaggctcagcacacgctccttggcgcgcttggaaatcagcggcccgacatcggtgcccggctcgctgccggcattcaccttgagcttctgcgccagcgccttgaggtccggcagccattgtttcgccgcgcccaccaggaccaccaccgaggtggccatgcaacgctggccggccgcaccgaacccggcaccgatcagggcattgagcgcctgttcgcggttggcgtcgggcagcaccacggcgtggttcttcgcgcccatcatcgactgcacgcgcttgccgtgcttgcccgcgaggtcgtaaacgtgggtgcccaccgcggtggagccgacgaacgacaccgccttgatgtgtgggtgggtgcacagtttgtccaccacatccttgccgccatgcaccacattgagcacgccaggcggaacgccggcttccagcgccagctccaccagcagcatggtcgacagcgggtcctgttccgaaggcttgaggacgaaggtgttgccgcaggcgatggccatcgggaacatccatagcggaatcattgccgggaagttgaacggggtgatcccggcgcagacaccgatcggctggcgcagggtgtaggtatcgacgccaccggcgacgttctcggcgaactcgcccatctgcaggctgccgatcgagcaggcatgctcgaccacttccaggccgcggaaaatgtcgccttcggcatcggcgatggtcttgccctgttcggcgctaagcacctgggcaatacgcttggagtgttcgcggatcagcgcctgcagcttgagcatgatgcgcatccgcgcgccgatcggggtcagcttccaggtctggaaggcgcgatgcgcggcttcgatggcggcatcgacttcatccgccgtggcgaaaggtaccttggccagcacctgctgggtggccgggttggtgatgtcgtgccattcgcgggtctgggattcgacccactggccgtcgatcagcagcttgacctgctgcaaggtggtgccgtcggacttgagggatgcgttcatacgggtctcctgacttcttgaggttcttatgcagggagccaaggcgtgggaccgccttgaaatgaggcgtgcgtcgcgagttggttgtcggactgtttttggagtatagatgtgcaaacttctaataagaacgcacataaaagccggtccatcatgcaaaaaaacatcacctccctcggctcgctgaactgggacgacctgaagtttttcctcgaagtggcgcgcacccgcaaggccagcagcgcggccaagcgcctggcggtggactacaccacggtgtcgcggcgcatcggttcgctggagggcgcgctgggcaccctgctgttcgaaaagtcccggaccaacggctttgtcctgaccgccgagggccagcgcctgctgggttatgccgagtcgatcgaaagcaccctgcacatggcctgcgaacaggtctcgggctcgggcgtggccctgtccgggcatgtgcgcatgggctgcaccgagggtttcggcagctttttcatcaccccgcagctgagccatttcgtcgacgcctacccggcgatctcggtggatatcctgccgctgccgcacttcatcagcctgtccaagcgcgaagccgatatcgtcatcgccctggaacgcccggagcatggcccctacgtctgctgcaagctctgcgactaccgcctgcggctctatgcgacccaggaatacctcgaccagcacccaccgatccgccgcccggcggacttgagcgagcatcaattcatcagctacgtggacgacctggcgttcagctcggagctgctgtacctggccaacgtgctgcccggcgccagcgccaacctgcgcagcaccagcgtcatcgcccaatacgtggcggcccagcaaggacgctcgctggcgatcctgccgtgcttcctggccgcccaggacccgcacctgctgccagttctgccggaggaaatagacatcacccggcagttctggatgtactgccgcgaggacctgcgcaagctcaagcggatcaccctgttgtgggactacatccgcagcgtgaccgaacagaatcagggcctgctgatggggcagagccgggagatggtgtttgccgactcatagtcctgcaggaagatcagcaggccctgccaaggctttgtggcagggattgatcgtaattgccggagcccgacagactctccatccaagttcagaatcgtcctaaagccttagccatctccacttgctagattcgcaaagctcgacaaagagcctcgcggatcagctaatgcaaggacgataaatgctctcttctgctcgcctgggcgacaaacatgtttgcccgcttcccggtcacggtacgacacctattgcttgcgcttctggtgacatcaacatcaacttcatgggagcagcccgagtcggtgacacttgcggctgtggcgcagtcatcaccacggggtttccatcgatcatcctgaatggtcgtcctatggcgcacttggggagccccaccagccacggcgggacaatcatcacggggtcgggtgacaccttcggtggttttgtcatggggcctgctcctggggctgcaatcatcaacttcgcagcactcggcgtgtttcgcccggatggctcggtggacgatgaaaagatggcaaccttgttggctgacccgaatctgatggagaaggctagcgctgcaaatgccttggttgatcccaatgcggcctctaaggcgcccgaagagaagccagaggagaaggcctgtaccgaccccgatcgcatggaggaactggctgcctatattgcgggcgagatgaatgccaacatcaacagcccgtctgtgcgacagatgaaggatttgaataactttgacccagcaatggaaacacgaaaatacgctgagcttccgttctacatgcggctcggtcccggcccagacttctacagtttggcgctcggaaagaaagccaaggcttttgctatctggacagagcgagtcggtcagggtcgcccatgggaccacaagccaatactctcaaggaagtacaacggcgtcgtttaccacaaacagggtgattacgattacttctacgatatctggtcgaacgtccactatggctatgtggggatggccggaggtctttccgaaagagtcctacttgatggcgcaggcatagagcaaatagggtccgatacgtatcggaaggctgaagaagtagtgttcaaacccaaagaacagtggaaactaccaggcccgcaccgctcagcagatatcgacggtatgcgagcatgggacgatgccccggatcgaatttccattggcatggcatcaagctctatcggcaatacccaaacgggggcgtcacggcgaaactgataatggatgaagtacttgcggtcacaccgcaagagtgggggaagggagtcaaagtacatgaatgtaaataaacctaaattcagatatggccggtggatatttctattccttgtggtctcccctattgcgttttggtatttcgcatctccagtcgtagcagtcaacttctcacatgatgggcaggaggagtttcgctatatctggaacacacagcaccgaatttataaaggagacatgccgccagggggtggctccgcagtcgaggttagccacattttccctgatgaagacttcttcatgatgttcttttggtggactgacaagggctttcagcggtgcatcgacatcacacccaaatgggggcggatgatagacatctaccttgatgcagcaggcaggatcgacaccactaaaactaccgctgacgtgatcgctcgcttgaaaaaatgcgagggcgagcctgatccattccggccctaggcttcctgccaacagcgctgcaaagacctgcgcaaactctagcggatcatcctgctgcgcagaatgacgggaacaggatcagggcctgctgatggggtaaagccgctgatggtcttcgcccatcagtcggcgatgaccacgatcgagacgcgacggttttcggtgcgtccggccaccgtgctgttggaggccaccggctcgctgctgcccaggccgcgcagctggatgttttcttcgcgcatgcctgtggccaccagtaccttgcttacgcttttcgcccgccgcagggacagttgctggttgtagctttccctgccggagccatcggtgtggccatcgacccggaccttgtcgatgtgcacgctgaccagggccttgccgatgcgctcgacaatctcggtactggcggcattcagtgtctcgatatcactgccgaacagcaccttgccggacaggccgaaggcccagccctcgtccgtcagctcaaagccctcctgcttgagcaccgccacttgctgcggggtcagccccttgggcggcacgctctggcaaccggtcaatgaaagcagcgccagcaacaggccggtggtgaaaagtcgcaagcaaggtcgagtcagtgaaaacaaagaattagctcctggattgaacgtgaacgacggggggctccgaccccgcggtgtgttgcccgcctcgagagacacgcttggcctgatacatcgccgcatcggcggcgttgagcagagcacccggggtggtgccatgatcagggtagacggcaataccgatactgagtgaagtcagtaccgaagtactgcctggcaaggcaatcggcatctccatgctggcgatgattttttcggcaatacgctcggcatcctcgatgcggtgcagcggggtcagcagaatggcgaactcgtcgccccccaggcgcgccaccaggtcttcctcgcgcaactgcgcgcgcacccgcgacgccaccgccatcagcaccgcgtcaccggcggcgtgaccgaagttgtcgttgatgcccttgaagcgatcactgtcgagaaacagcaccgccacccgttcgttgagcttgctggcgctgcgcagcgcgcggatcagccggccctcgaaaaacgcccggttcggcaacccggtcaggctgtcatggctggcctggtgggccagggtctcgttttcactctgcaagtgggtttgccaggcttccagctcatcgagcagggcattgaagtcgttgcccaggttgtccagctcggcaatttccgccggcggcacccgaacgtcgaatgcccgctcgcggcgcgcggcatgggccacatcggccaggctgcgcagcggcccggtgatgccgcgcaactgccggcgcgccagggagagcgccacccaggcgctcaccgcgatacacaggacaatccccaccagcccactgagcaggaagcgcagcaggctgccgccgtgcccggtcagggcgatgctgccgatttcctggccctgatgcatgatcggcacggtgatgggcttctcgagaaaggcccgggcgatctgcatttccagatcggtcagcaaaccgatttccggccgctcccaatgggccagcacacgtccccgggcatcgagtacctgggcatcggccacctcttcggtggaggcaatcagggccagggcttcggtcgccgcggcgctgtcgttgaacaccaccgccgcttcgaccgtgtaattgatcgaacgcgcgatcagatgcaggttgtgatcggcatacacccgcaacgccagcaccccgagcaatgtcagggacaggctggccatggaaatggccagcaacgcgacagtcaggttcccgcggccaatgaccgaacgcaaggtagggcgagcaggagatttgaagaggctcatggcaccgccggtcgacgacgggagagttgcagcacgcttggatgaatccgcacgccactgcgggccaccgaatccaggttgacctcgaatgacacctgattgtcactgacgcgcaggcagaacaggctaccaaccgtgcactggtcgccgccctcactgatgctcaataccggatgaccgaccagggaagtgaacaggcgggcgcgctggtcgtcggtcagcttgccgatgtacaccgcatcgcactcgctgacgatggccgggttgtcggccagcaagcgctgcaccagaaccgggcggcccgtggcctgggtcgtgcccttgaccaggtcgtcggtgtattcggtcggccccaccacacacagacgcaattgcgccggctccaccggccagcgcgcataactgagaatccccagcaccacttgagtcaccgccttggcgcgctggtctgccaggctggtggcagcaggctcgggttgcgcgacggcaaaagtgctcaacagacagaccagggcggacagcagtacctgcctccagcccgaaaagcgctctgtcgctgagacagccacgttcatgcagggattctctttgatcttcatacaatgatgccgcaacgatagcacagccggtgaaaccgccgcgaggttcccaggtatgggtagcaggctattggtttagaaaaaaatgaagtaacgatttgagccttcctattcttcatgcctgcatcgcctgcttaagatcggcgccagagagcgagccgtccagagcgccctcggtgagaccggatccgcagagacccggctcaaggaatgtcttttgctactgcccagtatcgccgcttcggcccagtgcctttgcggtgccatgagtagcccaagacatctttgaggttagccgatgcaactggaaatattccgcacactctggggctataccgccagcccagcccaggccttcgacgagctgctggccgccggcttcgacggtatggaagcccgcctgcctttgcaagcccgcgaacgcggcgaattcggcacattcctgcgggacaatcgcctcggctatatctgcacggttttcaccgcctacgacgtcctgccaaaacaatcggccgcgtttcaggaacacctgctggacctggagcgcaagctcgcctgggccgccgaactggcgccgcgcttcgtcaatgtgctggccggcaacgaccgctggcccctggcccagcaagtcgagttcttcggccaggccatggagctggcgcgcaagcatggccagttctgcagcttcgagacccaccgcgcccgttcgctgttcaatccctgggtcaccctggagctgatccggcaattgcccgacctgcgtttcaccagcgatatcagccactgggtcgtcacctgcgaacgcctgctggatgaccccttcgatgacctgagcgccttcgtcgagcgcgttcaccatatccaggcccgggtcggctatgaccaggggccgcaagtcccgcaccccgccgccccggaatatgcccgtgaactggcgttccaccagcagcactgggaagccatctggcattcgcaaaaggcccgtggctaccaggtcagcaccctgaccccggagttcggcgccgacggctacctgcatcacctgcccttcaccaacgtgccagtggccgacctctggtcgctgaaccagtggatggccaggaccgagcgcgaacacttcgaccgcttcacccactcaacccgtccgtgaggttcttgcgtcatgcccgagaagatcgataacaccccggccaaggccaacttcaaacacattccggtggtggacatcgccggcctgttcagcatcgagctggagcaccggctggccgtcgccgagcagttgggagcggccgccagcgaagtgggctttctctacatcaccagccatggcatcgacccgcagttgatcgccggcctgcgccaggccgccagggactatttcgcccagcccctggacagcaagatgcagcactacatcggcacctcgaaaagccacaagggtttcgtccccgagggcgaggaggtgtattccaagggcaagccggatcacaaggaagccttcgacatcggcttcgaagtaccggccgacgatcccctggtcctggccaacacaccgctgctggggccgaacgagtggccagaactgcccggcttcaaggaggccgtgcaagcctattacgcggccgtcttcgccctcggcaggcgcctgttcagcgggttcgccctggccctgggcctggaggaaaactatttcgacgccctggtcacccgcccgccttccaagctgcgcctgatccactacccgttcgacgacgcggcccaggatgcgcccggcatcggcgcccacaccgactacgagtgcttcaccatcctgctggccgacaagccgggcctggaagtgatgaacaacctgggccagtggatcgatgccccgccgctggccgacgcctttgtggtgaacatcggcgacatgctggaagtgatgaccgccggcgcctttgtcgccaccgcccaccgggtgcgcagcgtcagcgaggagcgctactcgttcccgctgttctacgcctgcgacttccatacccagatcaagcctttgccgcagttcgccaaggcctcggacgactacgagcagatcgccatcggcgagcacatgtatggccaggccctgcagacctaccagtacctgcgcaagcgcgtggagaacggcgagatccgcctgccggaaaaagcccgcaagccttcgagcttcggccacctgaaacaccagtcgcaagcgtcctgacacccttttgccctttgcttccatcccctggagagacccacgatgcttaacaaaaacaacgttgctcgcctgaccctgctcaccgccggcctgttgtgcgccaccgctggcctggcctcgaccgcgacacccggacagctgaagatcggcatggaaatcacctacccgccgttcgagtcctatgacagcgagaagaacgtggtcggctccgacccggaactggcccacgccctggccaggcacctgaacgccaaggccgagttcgtcgacaccaagttccccagcctgatcctcggcctcaacgccggtcgctacgacgcgatcatttccggcatgtacatcaccccggaacggcagacccaagccatgaccatcgcctatgcgaaaaccggcgcggcgatcatgacgtccaaggacagcggcctgaatccacaaacccctgaagacctgtgcggcctgaaggtcgggctggaacagggcaccacctgggtcagccagttacagaagctctccagcgactactgcgtgccaaacaacaaaggcgcgatcagtgtcagcgaatacccctcggcacctgaggtgacccaggccctgctgtcgaagaacatccaggcccaggtggaaatcgccggcgcggcgaagatgatcgccgaacgcacccagggtcgggtggtagtcaccagccagcacctgatctatcagcaaaccctcggcatcttcgtcaagaaaggcaacgacgccacctacaaggcgctgcaggaagccttcgccgagagccgcaagaacggcgagtacgccgcaatcctcggcaaatacaacctggaaccggtgactgactgacaagccactgcggcgcacggatgcgcccgtgaccggcccccgatcgagcgcgcagcgcccgtcctgatgcctgcgatccgaagccgcccgaggtgtttatgcaattcgactggtcctacttcatctccctgttttccctacccagcttctggcatgcctgcgtcaccgtggtccagctcagcgccctggcctggttcatcggcatgctgctgggctttctcctggcctcggccaaactctccacggccgcctggatcagaaccccggcagcgctgtacatctggttctttcgcagcattccgctgctggtgctggtggtcttcgtctacaacctgccccagctgtttccggccaccggctcggtgctgtccaaccccttctactcggggctgctcgccctggtggtgaccgaagcggcgtacatggcggaaatccatcgcggcgggctgatctcggtggccaaggggcagaaggaagccggccgcgcgctggggatcggcctgatcggtctgcaacggttgatcgtcatcccccaggcctttcgaatttccctgccgaccctgatcaacgagtacatcaccgtggtcaagctgacttcgctgatctcggtgatctccctgaccgaactgctcaccgtcggccagcgcctgtatgcgcagaacttcctggtgatggagaccctggccgcggtggcggtgtactacgtgctgatcgtcaccctgttcgcttggctgctgcagcgcctggaacgccacctggacctgaacctgcgcaccccgcaaaccctggatgccgccggcaccgagcggctccggcaacaggcacaaccgcagcacagccgccctcgcccacgaccggtagccggcagcgccccggccctgcaactgcaaaacatccacaagcactacggcgatcatcaggtgctcaagggcgtcgacctgaacgtcgccagtggccaggtgatttccatcatcggtccgtccggctcgggcaagacctcgctgatccgcaccatcaacggcctggagcgcatcgaccagggcgagatcgtgctgttcggcaacagcttcatcagcgccggcgacaacctcaacagcccgcaggtgcgcgagggcgtgcggcacatcggcatggtcttccagagcttcaacctgttcccccatcgcagcatcctcgacaacatctgcctggcgccgcgttaccacggcagcagcaaggccttgagcgagcagcaggcctacgccttgctgggcaaggtcggcctgctggcccacgcccacaagtacccgcaccagttgtccggcggccagcagcagcgcgtggcgattgcccgggccctggcgatggagccgcagatcatgcttttcgacgagccaacctcggcactcgatcccgagctggtgggcgatgtgttgaatgtgatccgagacctggcccgagaaggcatgaccatgttgatcgtcacccacgagatggacttcgccctgtcgatttccgatcgggtgatcttcatggagggcggcaatatccagctggacgccagcccgcaaacgatccgcgaagcagcggcgggggaacgggtcagacgcttcatggggctggagcagccaagcgcgacggcactggcggcggcgctctgatcgagtgccgaacgccagtgccccggcgttcaacccaggtcgagcatcaacccgctcagacgcttgaccttgcgccgcaccgcctcttcgaacaccccggcccgcggctcgatcaggctgaaccagtccttggcccgggtgatgccggtgtagatcagctccttggtcaacaccgggttcagcgcctcgggcaggatcagcgcggtgtgggcgaactccgagccctgggatttgtgcacggtcatggcgtacacggtttccacatcgttgagccggctcggcaacacgaaacgcacgccaccctggccatcgttacgcgggaaggccacccgcagcacctggcgcccgtcttgcgtgccttcgtgctcgggcaacttcaaggcaatgccgatatcgccgttcatcaggcccaggccgtaatcgttgcgggtcatcagcaccggacgaccttcgtaccactgctgatcgctttcgatcagccgcgccttgaacagggcggcggtgatccgctggttcaacccctcgacaccccaaggccccttgcgcaccgcgcagagcaactggaactggtcgaaggccagcagcacatcgcgggcccaggcggtccagcgcggatcttccagcgccgtatcggcaggcgggcgctggccgcgcaacaggctcaggtaatgccggtaaccctgcggcccgtcgccatggccttccagcagcaagcgctccagggcgcggtcctgctcgcccttgaggctcaagccatacaggtcggcatggctgcgggcggccagcaggcgacgcgcttcctcggcctgctgctggttgacccagcgcgccagctggccgataccgctgccttcgccgaagcgccgggagtggcgcagcatcaccacctgctgggccagcgggtgaacgccggcgctgtcttcctgcagaccgctgtccgccagctgttcgccgctgacggcctcgagccagctgcgggtctgcgggctgtaccagccggcctcggcatcgcggcacagatcgccaagcaccgcgccggcttccaccgaggccagttgatccttgtccccgagcaacaccaggcgcgcgtgtaccggcaacgcatcgagcagattggccatcatctccaggtcgatcatcgaggcctcgtcgaccaccagcacatccaggggcaagcggttgccggcgtgatggcggaagtgccgggttcccggacgattgcccagcaggcggtgcaccgtggtgacgtcgctggggatcttctcgcgcacactgtcgtcgaccgacagggaacgcacttgcaggctgatggattcggtgaggcgcgctgccgccttgccagtgggcgcggcgaggcggatgcgcaaaggcttgccggcttcgacagccggggcctggagcaaggccagcaggcgtaccacggtggtggttttaccggttcccggcccgccggtaatgatactgaaggcgcctcgggtggccagcgcacaggcaagcttctgccagtccaccggccccgccgccttggccgcgccgaacaggccgccgaggcgctcggccaaatccgcgggggtttcctcctgcaccgccaggcgctggcgcaaggcattgtcgatgcgccgttcataggcccagtagcggcgcagatacaggcgcttgcccgacagcactaaaggccgctggcgagcttgctcgctctggtcggccgccagcgccaccaggcgactggccgccagggccttgcaccagtgcgcgccgtccagcgtcgccagcacctgcgacggcagtaccgccgccgtgctttgcaggtcgccttccggcggcagggacagggcgaagtccggctccttgagggtttcgaacagatccaggcaaacatgcccgtggcccagttgatggctggtcaacgctgcggccatcagcaccagtggatcgccttgtggctccagctcatggaggaagcctacgaaagccttgtccagggcgcgcaaccagccgcgctcgacccaacgatcgagcaacagcagcaaatcgccggcccgtaccaggggcgccaggtcgggatggggctggggttccagcggcgtcagcagatcctcgatcacagcaatactccctgttcccacgccggctcggccttgggctgctcgggtttgccctggaacaaacggtccaggcgctcgatcagctcacggggtggccgggtgaaaaacacgccgcggctggccgaccccgtgccacgcaagaacaggtacagggcaccgcccatgtgccggtcgtaatcgtagtccgccagacgcgcgcgcaactggcgatgcagggccagcaggtacagcacgtattgcaggtcgtaacggttgtcgagaatcgattgttccatggcctgctcggtataggcggcgtcatccacgcccagccagttggacttgtagtcggccacgtaatagcgcccttgatgctcgaaggtcaggtcgatgaagcccttgaacatgccattgagcaggacaggttcggcggtcacccgcggcacgccttgatgggtgtactggcgcaccagctcgtcgagcttgagcacatcgaccttgtggctggcgaaccagaattccatctcgacccggtattggctcaactgtgcgagcaccaccggcggtcgccccgccccggctggcaaaggcagttgcaacagatgccgcaaccagtcgctcagggtcttgatccagccttgccaaccgcggcgattacagcgccgagcgatggcgtcctcgatggcgacggggtcggcggcgaacccctcgtcaccggcccactccagcaggccgtggaggaaggtccccgggttcggcccacgggggaagcgatggatgtccgcgccgctggccacgacttcacgcggggcatcggggtcgaggcgctcatcgtcgaagagtttctgcgcctgcgggctttccggcgcctcggtattgccggcgcccaggctgtcgctgatacgcagggcgctataggacgcgatccaccagttctccgcggcgcgccgcttgggagccaggggtgccagcagggtggcgtcgttgcgcggcggatggaagcggctgtcggaggcgctgggcatttcgctgacactcatggcctcgcagccttgctgcaggtcttgcagccagcgcgccaggccgctggactcgttcaacaacgcaccgccgcccaacaggtagcccagggccgagaggtgcagcaccgagctgttgtggttgccgcgcttgaggtcggcgacacccagccagcaggcatgctgggcacgggtcagggccacgtagagcaggcgcaggtcttcggccagacgttcgtcgtcggcctgggcaatcagctccggggttggccgtagcgtcacctgggccttgcccgactcgtcgtggtagcgcagcggcaggcgactgccatccaccggcttggccgaacagatgaacggcaggaacaccagcgggtactccaggcccttggatttgtggatggtcaccaccttgaccagttgttcgtcgctttccagacgcaggatctgttcttcgccagcctgcccggacaaggccaggtgttcggccagatggcggatcagcgcttgttcgccgtccagctcggcggccgcctgctgcaacagttcggacaggtgcaacaggttggtcagcacccgttcgccatcgctgcgggcgatcagggcctggggcaactggaagtcatgcagcaggcgtcgcaacatcggcagcacaccctgggtacgccagatcaggcgataaccgcggaactgcatgacccggctctcccaggccagctcgtcctggttcaggcgctccagctcaaccagcggcaggttcagggtgatggaggccagcgcggcgcgtagtggacgctcgatatccggttcggcacaggccttgagccaggccagcaggtcgtgggcttcctgggcggcgaacaccgagtccttgtccgacagatacacgctgcgcaccccgcgcgcggccagttcgccgcgcacggcctgggcctccttgccatcgcgcaccaggatggcgatgtccgccggcagcaggcccttgaagggctggccgtcacgggcgaagccggcgctggcctgctgcccgccgttgagcaaggcgacaatttcgctggcgcaggccgccgccagttgctgccgatacagcgccccggaaatggcttgctccgaggacaggtgccagacattcagcgccggcaccacctgcccttctctgtgtagctgctccttgcgcccctgggaggccaccgacaggaacggcaccgggttctctccgttcttttcccggaacaggaacgcgccgcgcccctgttcacgggactcggcacgctcgaatacgtggttcaccgccttgaccatggcgtggctggaacggaagttggtgcccagggtatgcaagcggccgctggtggcctggcgagcgcgcagataggtgtaaatgtccgccccgcggaaggcgtagatcgcctgcttggggtcgccgatcaggaacagcccggtctcggggttgttgtcctcgatgcggtagatgctttcgaagatccggtactgcaccgggtcggtgtcctggaattcgtcgatcagggccaccgggaactgctcgcgaatcagcgtcgccaggcgctcgccaccctcggcctgcaacgcggcgtcgaggcgcagcagcatgtcgtcgaagcccatctcggcacggcggcgcttctcctcctcgaagcgcgcgccgaccctaacgcgcagcgtgttgcaataccgcggcgtcggggctcggcaaggcatcgagcgcggccttgagcccggccatggcgtccagcgcgggatgatccggcgcatcgcctttccaggcctcggccatgccttcgggggtcaggcggctgaagccggtaccgatatccagttgttctatggactcgtcttcggcccaggtggtgatcttttcgaaccagggctcaaagtagcgcgcctgcatcttgcggccatcaacggccttgctggcgacgccttgcaagcagatctcccgcagttgctcagcccattgccgccaaggcgccttgagctgcaccaacgccgcgcgacgctccagcaagcaggcttcgatcaactgcgccggcgtctgctccgcgtccacttcccgctcgctgccaaacagcgcgcgcaccctgggcagcaaggccgcgggcccgctccagttggcccgcacccagttcagcgcatcaccctgcatcgggtagcaaaacaggcgccagtagtcgcgcagcacttcgcccagcagatcgctgtggtcggtttccagggtctgggtaaacaggctgccgctgtcgaacgcatgctcgcgcagcatgcgctggcaccaactgtggatggtcgagaccgcggcctcgtccatccattgcgcggcgatgtccaggcggctggcgcagcccggccattgctcggcggcgaactgatcgcgcagctcggcaatcagcgcgtcgggcgcggcggtttcatcgcggaaaaagcgtgcggcttcagccaggcgggtgcggatccgctcgcgcagttccttggtcgccgcgtcggtgaaggtcaccaccagaatctgcggtggcagcaactcgcgaccgaacccggccagctcgccgccgtgccccagcaccaggcgcaggtaaagcgccgagatggtaaaggtcttgcccgtaccggcgctggcttcgatcagttggctgcctcgtagcgggaacgccagggccaaaggtgcttgccgggtcatgcgtcagcctccccattggccgcggagcgccagggcgcctgtaagagtgggcgatacaacgcatcaacccaaccgctgaaggtttcgtcggcgatcaacgcgttgtagtccgggtactggcgcgccagggccgggctttcccgacgctcgccatcgctggtctggccgtcgccttcataagctttgcgcgccgccgcttcggccttgcccggatcgctctggcccagccaggcaaaggcggttttcacggctaccgacagcggctggcacatgcccgcctgccaggccagcagcagatcgcccaggctttgcagcgccgcatcgcggtccagaggcggcagcaacaaggtgtcgtcgctggccaccagggcggtggtcaaggtgtagccgctggcacaggccaccagatgattgacccagggccgggtcaggcggtgccatttgcgggtcttgggtgagccgatgctgttggggatggtggtgaccgatagcagcccgccatcgctgcgttggtgcaagccgctcagccagccttcgagtttcacttccttgagttcaagggtaatcggcaaggcgctggtgaccggcgttggccataattccagcaattgccgataacgcatcagcagatccggcaagggctcgatcagctctcgttgcaggctctcgccaaaaccggccatgggcagcaaaccgctggcctgtagccgttgcgcctgggcctgcagggcctggtccggatcatcggcgcagttcaacgccgcctccagcaggctgtcgctcaggctgtagcgttgcagcgcgtcgagcacaaaaggctcttcgtcggccaacggcgcgtcggccgcctcgaagaacaccttgagacgctgactgaagaaatgccgcaccgggttacgcaggaagtcctgcaactgccccaggctcaaaggctcttcctggacatagggcgccagagcttcaagcgtttgaggagccgcttgggtctggtgcaacagctgccactcacgggcatagctgaacagcccatggccttcatggaaatagcaggcactgaaaggttgcagtggatgctcctgggtcatggcgtcgagcagatcgtcctggtcattcgccagcttccagccactggccaggtgatcgcgcaactggccgatcagcaccgaggccgggcgttcgctgttgtcgcgaatgctgcgaccgacccaactgacgtacagctgatcccgcgccgaaagcagcgcctccagcagcaggtaacggtcgtcttcgcgccgcgagcggtcaccggggcggtagtcgctgcccatcaggtcgaaatccagcggcggctgcgcccgcgggtagtcgccgtcgttcatccccagcaggcacaccagcttgaagggaatcgcgcgcatcggcatcagcgtgcagaagttcaccgcaccggccaggaaacgctgggacaagcgcccctggtccaggccagccagccaggcttcgcggaccacggtcagcggcagctcatcatgcaggccaaccgactcgcaggtttccagccaggtttcgcgcaagtcttcgagttggctcagcaggtagtcgtcatgctcggtactggccaggaagaactgctgcgtgagtgcttgcaggcgcccgccccactgcggcggcgaagccggcaaagtgaggttctgatacgccatctccagggcatcgagcaaggccaccagcggcccgatcagtgccgcatccaggccaccgatctcgtcgtaaggctcgatcccctcgcaggcatcggagcgtcccacggcgtaacccagcaacatgcggcgcaggccgaaacgccagctgttctgctccagctcttctggcaaccccaggtcggcccgttgttcggcgttcatgccccagcggatgccggcgccttcgatccagcgatgcagggtcggcagatcggcctcatcaacgccaaaacgtgcgcgtaatgccggaacatccagcaggtcgaggatttcgctgacggggaaccggctgtccggcagcttgagcagatgctccacggcaatcagcagtgggtcgcggccacgttggccctggtccgtcagggtgaacggaataaaacgccgatcgtcacgctccaactggccgaagaccgcgcgaatatgcggtgcgtaactgtcgatatccgggaccatcacgatcacatcccgcggacgcaattcagggtcctcactgaagcgcgcaagcagttggtcatggagaatttccacttcgcgctgggcactgtgggcaatgtgaaaacggatcgacttgtcctggtgcagatcgaccgccggccacaactggcgggtctcctccagcgggcgcaattcgaggatatcgtcctgcagctgattcagcagggtctgcggctgactctcgctgaacaggtcgatacggccgtcgcgaaaagccgaacgatagctgttgggatcgtcgtagctgtcgagcaggttgatgtagtcgcggccctgtttaccccaggcggcgagcagcggatgggcatgttgatgcagggtctgcggatcgagcaccgccggcattcccgtcttgcgcgcctgacgcttgtattgatggcgcagcaggtccttgtcggcgacgatatccgcccaatggtgacgacaagggttgtgtacacacagcagtacctggctgaagcgggccagtccggccagggcttccagggcttgcgccggtagggaggaaatcccgaaaacgatcactcgcgagggcaacccttgtggcgctgtttccaggttgaggattcgttcgatgaaacgttgatgaacaccggcgcgactttgcgccatgccctcctcccccacatccagcaacaacgcccgccacagttcggcctgccagcagttggcgggggtcagggctttagcttcgcctcgagcgctgcgtagttgatgccgtcctgcggcccagtcttccagccaatcggcgcgatagacttgatattggtcgaacaggtcagccaggcgctcggccaattgatagcgcttgcgcagatccgtgtcgtgagtaaggaaacggcgtaggggctcgaagtgcggctgatcgatcagttcgggcaaaagacgcatcaggcgccaggtcagcggcgccttatccagcagtgatttgggcgggatttcatcgcgtcccagcaccatgcgataaagctgccacatgaaactgccggggagctgcacatcgatggcagcagcgatgccacagccgcccatgtcgtcatcctcaggatcctcagccaaggccagcttcagccattgggcaatgccgttgctctgaaccagggcgatctcattctccagcggcgccaaggggtaacgccgcatccagctgaccaccaggctgcgcaactcgtccaggcggttaccgtgaaccaccataaaaccagcgctgagggacatggcgtccggcataagggcttccttggaaaatgcaaaagctagggccgaaccttagcactgtcacgcagcggtgacagctgagaggaccaacgtgaatgttgcgagggatgaggcattttttgtcgcacaaaaacaaaaccccaattgctttcgcaattggggtttcggaatttaatcttgacgatgacctactctcacatggggaaaccccacactaccatcggcgatgcatcgtttcacttctgagttcgggatgggatcaggtggttccaatgctctatggtcgtcaagaaattcggtgtgccgacgcgtctttcgacgtttcagcaaattgggtatgtaatagctttgtgtgttcgcaaactttcggttcgtttcgtcttcacacaccgcaatctggctgttaagcgcaaattgcttgggtgttatatggtcaagcctcacgggcaattagtattggttagctcaacgcctcacagcgcttacacacccaacctatcaacgtcgtagtcttcgacggccctttagggaactcaaggttccagtgagatctcatcttgaggcaagtttcccgcttagatgctttcagcggttatcttttccgaacatagctacccggcaatgccactggcgtgacaaccggaacaccagaggttcgtccactccggtcctctcgtactaggagcagcccctctcaaatctcaaacgtccacggcagatagggaccgaactgtctcacgacgttctaaacccagctcgcgtaccactttaaatggcgaacagccatacccttgggaccggcttcagccccaggatgtgatgagccgacatcgaggtgccaaacaccgccgtcgatatgaactcttgggcggtatcagcctgttatccccggagtaccttttatccgttgagcgatggcccttccatacagaaccaccggatcactaagacctactttcgtacctgctcgacgtgtctgtctcgcagtcaagcgcgcttttgcctttatactctacgaccgatttccgaccggtctgagcgcaccttcgtactcctccgttactctttaggaggagaccgccccagtcaaactacccaccatacactgtcctcgatccggataacggacctgagttagaacctcaaagttgccagggtggtatttcaaggatggctccacgcgaactggcgtccacgcttcaaagcctcccacctatcctacacaagcaaattcaaagtccagtgcaaagctatagtaaaggttcacggggtctttccgtctagccgcggatacactgcatcttcacagcgatttcaatttcactgagtctcgggtggagacagcgccgccatcgttacgccattcgtgcaggtcggaacttacccgacaaggaatttcgctaccttaggaccgttatagttacggccgccgtttaccggggcttcgatcaagagcttcgcgttagctaaccccatcaattaaccttccggcaccgggcaggcgtcacaccctatacgtccactttcgtgtttgcagagtgctgtgtttttaataaacagtcgcagcggcctggtatcttcgaccggcatgggcttacggagcaagtccttcaccctcaccggcgcaccttctcccgaagttacggtgccattttgcctagttccttcacccgagttctctcaagcgccttggtattctctacccaaccacctgtgtcggtttggggtacggttcctagttatctgaagcttagaagcttttcttggaagcatggcatcaaccacttcgtcacctaaaaggtaactcgtcatcagctctcggccttagaaccccggatttacctaagattccagcctaccaccttaaacttggacaaccaacgccaagctggcctagccttctccgtccctccatcgcaataactagaagtacaggaatattaacctgttttccatcgactacgcttttcagcctcgccttagggaccgactaaccctgcgtcgattaacgttgcgcaggaaaccttggtctttcggcgtgggtgtttttcacacccattgtcgttactcatgtcagcattcgcacttctgatacctccagcaagcttctcaactcaccttcacaggcttacagaacgctcctctaccgcatcacttacgtgatacccgtagcttcggtgtatggtttgagccccgttacatcttccgcgcaggccgactcgactagtgagctattacgctttctttaaagggtggctgcttctaagccaacctcctagctgtctaagccttcccacatcgtttcccacttaaccataactttgggaccttagctgacggtctgggttgtttcccttttcacgacggacgttagcacccgccgtgtgtctcccatgctcggcacttgtaggtattcggagtttgcatcggtttggtaagtcgggatgaccccctagccgaaacagtgctctaccccctacagtgatacatgaggcgctacctaaatagctttcgaggagaaccagctatctccgagcttgattagcctttcactccgatccacaggtcatccgctaacttttcaacggtagtcggttcggtcctccagtcagtgttacctaaccttcaacctgcccatggatagatcgcccggtttcgggtctatacccagcgactaaacgccctattaagactcgctttcgctacgcctcccctattcggttaagctcgccactgaatataagtcgctgacccattatacaaaaggtacgcagtcacagaacaaagtctgctcccactgcttgtacgcatacggtttcaggatctatttcactcccctctccggggttcttttcgcctttccctcacggtactagttcactatcggtcagtcagtagtatttagccttggaggatggtccccccatattcagacaaagtttctcgtgctccgtcctactcgatttcatgactaagagattttcgcgtacagggctatcacccactatggccgcactttccagagcgttccgctaatctcaaagccacttaagggctagtccccgttcgctcgccactactaagggaatctcggttgatttcttttcctcagggtacttagatgtttcagttcccctggttcgcctcttgcacctatgtattcagtacaagataaccatcttatgatggctgggttcccccattcagacatctccggatcaaagtctgtttgccgactccccgaagcttttcgcaggctaccacgtctttcatcgcctctgactgccaaggcatccaccgtatgcgcttcttcacttgaccatataaccccaagcaatctggttatactgtgaagacgacattcgccgaaaattcgcgattaaactcacaaattttaccttagcctgaataaacaccagtgaaagtgctatccagtctatctttctatcacatacccaaatttttaaagaacgattctgataaagatcagaaatcaacattcaccatcaacttgatggaatgctcatttctaagctttaaacgatggacaccaatctgtaatggtggagccaagcgggatcgaaccgctgacctcctgcgtgcaaggcaggcgctctcccagctgagctatggccccgtatcgctacagggtgcaccagtaattggtgggtctgggcagattcgaactgccgacctcacccttatcaggggtgcgctctaaccaactgagctacagacccaatcgtcttcttcaatgaatcaagcaattcgtgtgggagcttatgaagcagctgatgtcgtcgattaaggaggtgatccagccgcaggttcccctacggctaccttgttacgacttcaccccagtcatgaatcacaccgtggtaaccgtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgggattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccattacgtgctggtaactaaggacaagggttgcgctcgttacgggacttaacccaacatctcacgacacgagctgacgacagccatgcagcacctgtctcaatgttcccgaaggcaccaatccatctctggaaagttcattggatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaagagctcaaggctcccaacggctagttgacatcgtttacggcgtggactaccagggtatctaatcctgtttgctccccacgctttcgcacctcagtgtcagtatcagtccaggtggtcgccttcgccactggtgttccttcctatatctacgcatttcaccgctacacaggaaattccaccaccctctaccatactctagctcgccagttttggatgcagttcccaggttgagcccggggatttcacatccaacttaacgaaccacctacgcgcgctttacgcccagtaattccgattaacgcttgcaccctctgtattaccgcggctgctggcacagagttagccggtgcttattctgtcggtaacgtcaaaatactcacgtattaggcaagtacccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaactagctaatccgacctaggctcatctgatagcgcaaggcccgaaggtcccctgctttctcccgtaggacgtatgcggtattagcgtccgtttccggacgttatcccccactaccaggcagattcctaggcattactcacccgtccgccgctctcaagagaagcaagcttctctctaccgctcgacttgcatgtgttaggcctgccgccagcgttcaatctgagccatgatcaaactcttcagttcaaacatctttgggttttgagaaaaccctaaacttggctcagcaatcgttggttacatctttgatttctcgcggagtaacttgtgatgctgataatctttctgactatcagtctgactccacaagcacccacacgaattgcttgattcagttgttaaagagcggttggttaagcctttcgtctcaaccgaggcgcgcattctacagcagcctctgtatctgtcaagcggttattttaagaagctttcaaagtttcctttgcaacttcaaccacttgcgcttccgatctctcgtcagcgggaggcgaattctacagcgttacacgctgctgtcaacacctctttttctccgctttcgaccgagaagatcgagaagatcgagaagatcgaatcgttaactcggcgaaaactgactgccgaaccaactccttcgggcttcgatgaactgaagcatgaccgctgtcgaaaaccgtgtaactcgttgaatctcaaggagttttccgtttcgactgcgccggaagtggggcgaattatagacttccagaatctgccgtcaacacttattttcacaaatctgtcatatcagtcaaaaagcccctaaaagcaaaggccgcccccaagggggcggcctttaatacctttctactttacaggctagggaaggcgaactgcgaggcttcatggctggcacgctgtggccaacgctgagtgatcgccttgcgacgggtatagaaacgcacaccgtccggaccgtaggcatgcaggtcgccaaacagcgaacgcttccagccgccgaagctgtggtatgccaccggtaccggcagcggtacgttgacccccaccatcccgacttcaatctcgtcacagaacagacgcgccgcttccccgtcacgggtaaagatgcaggtgccgttgccatattcgtgatcgttgatcagttgcatggcctcttccaggctgttcacccgcacgacgcacagcaccggcccgaagatctcttctttatagatgcgcatttccggggtgacgttgtcgaacaggcagccaccgaggaagaagccttcttcatggcccggcacgctcaggccacgaccgtcgaccaccagcttcgcgcccgccttcacgccatcctcgacataaccgctgaccttgtcccgcgcctgtcctgtgaccagcggccccatgtccaggccacaggaagtgccggcaccgattttcagcgccttgatctgcggaaccagcttggccaccaatgcatcggccacctggtcgccgacacacacggcaaccgagatcgccatgcaacgctcgccgcaagaaccataggccgcgcccatcaaggcactgaccgcgttgtccaggtcggcatccggcatcagcacggcgtggttcttcgcgccgcccagtgcctgcacgcgcttgccgcgcttggtgccttcggcgtagatgtattcggcaatcggcgtcgaaccgacgaagctcagtgccttgacttccggcgcttcgatcagcgcgtccaccgcggccttgtcgccgtgcaccacactcagcacgcctttcggcaggccggcttccagcaacagctgggcgatcagcagggtcgagctcgggtcacgctcggatggcttgaggatgaagcagttgccgcagacgatcgccagcggatacatccacagtggcaccatcgccgggaagttgaacggggtgatgccggcaaccacgcccagcggctggaagtcggaccaggcatcgatgttcgggccgacgttgcggctgtactcgcccttgaggatttccggagcggcacaggcgaactcgacgttttcgataccacgcttgagctcaccggcggcgtcttccagggtcttgccgtgttcttcgctgatcaactgggcgatgcgcgattcgttctgctccagcaattgcttgaagcggaacatcacctgggcacgcttggccggcggcgtgttgcgccaggccgggaaggcagccttggcggcatcgatggcactctggatggtttcgcggctggccagcggcagcttgtggatcgcctgaccggtggacggattgaacacatcgaccgcgcgaccgctctcggtcaccagttcaccattgatcaaatgcgggataacgctcatcggggaactcctgaagttgtccacaggcgcccgccaaggagcgcctgctgtttgtactcatatatagagggaggaatcagtcgagcttgttcagcacttcgccgacggcatcgaacagacgatccagatcctgcggcttgctattgaaggtcgggccgaactgcagggtgtcgccgccgaagcgtacgtagaaaccggctttccacagggccatgcccgcttcgaacggacgcacgatggcatcgccatcgcgcggggcaatctggatggcaccggccaggccgtagttacggatgtcgatgacgttcttcgtacccttgatgccatgcagtgccttctcgaaatgcggtgccacgtcagcgacgctctgcaccaggttttccttctgcaacagatccagtgccgccagaccggccgcgcaagccactgggtgcgccgagtaggtatagccgtgggggaattccaccgcgtactcgggggtcggctggttcatgaaggtctggtagatctcggagctggcaatcaccgcgcccatcggaatcgcgccgttggtgacttgcttggcgatgcacatcaggtccggggtcacgccaaagctgtcggcaccgaacatcttgccggtacggccgaaaccagtgatcacttcgtcgaacaccagcaggatattgtgctggtcgcagatttcccgcaggcgcttgaggtaaccctgtggcggcaccagcacgccagcggaaccggccaggggctcgacgaacaccgcggcgatgttggaggcgtcatgcagttcgatcagcttgagcagttcgtcggccagcgcgataccgccctgctccggaataccgcgggagaacgcgttgcttgccagcagggtgtgcggcaggtggtcgacatccatcatcgcctggccgaacagtttacggttgccgttgaccccgccgaggctggtgccggcaatgttcacgccgtgatagccacgggcacggccgatcatcttggtcttggtcgactgacctttcaggcgccagtaggcgcgcaccattttcaccgcggtatcggcgcattcggaaccggagtcggtgaagaacacgtggttcagattgcccggagtcagcgcggtgattttctcggccagctggaacgacagcgggtgaccgtactggaagcctggcgagtaatcgagggtgcccagctgcttggccaccgcctcctggatttccttgcgggtgtggccggcgccacaggtccacaggccagacagcgagtcatagaccttgcgccccttgtcgtcgaccagccagctgccttcggcggcgacgatcagacgtggatcgcgctggaagttgcggttagcggtgtagggcatccagtgagcatcgagcttgagctggctggccagggaagctggagcgttttcatgcatgttcatggggcaaaacctcgcagggcaataagcggcgcagggatcggaaagcgttgttgcagttaagttgccacggctataaagtcggtgaaatccaacttttataaccttcagtcagtggcccactaaactatgagcagccgtcgcgccgacccgctagcgcaagtcagcgactttgatatccgcctgctgcggatctttcgcagcgtggtcgagtgcggaggcttctccgccgcggaaaccgtgctcggcattggccgttcggccatcagccagcagatgagcgacctcgagcaacgcctgggcctgcgcctgtgccaacgcggacgcgccggcttctcgctgaccgaagagggtcgcgaggtgtatcaatcggccctgcagctgttgagcgccctggaaagctttcgtaccgaggtcaacggcctgcaccggcacctgcgtggcgaactgatcatcggcctgaccgacaacctggtcaccctgccccacatgcgcatcacccatgccctggcgcaactgaaggagcgcggaccggacgtgcagatccagatccgcatgatcgcccccaacgaagtcgaacaaggcgtgctcgacgggcgcctgcatgtcggcgtagtgccccaggccagtgccttgtccgggctggaataccaaccgctgtacagcgaacgctcgctgctttattgcgccgtcggccacccgctgttttatgtcgacgacaagcaactggacgataggcgcctcaacgagcaggacgccatcgccccgaccttccgcctgcccgccgagatccaggcccactaccaggcactcaattgcaccgccagcgcttcggaccgcgaaggcatggcgttcctgattctcaccggacgctacattggctacctgccggaccactacgccagcctctgggtccagcagggacgactgcgcgcgctcaagcccggctcacgtttttatgacctgagcctggcatcggtcacgcgcaagggccgtcgcccccatttggtgctggaaagcttcctggacagcctggcggccacccgctgaaaaaacctacgacactataaaagccccgcccccattgccccacaacggcaaacacaggcaataacctgagcacttggacagctttttgcagggcacgatgaccttgaaccatcagccctgagttccccgtccatgcagccagacaccttgcgccaaagcgacctgatctacggtctcgacgatcgcccgaaaccactcgccgcgatcctcgccgccctgcagcatgtgctggcgagtttcgtcggcatcatcaccccgtcgctggtgatcggctcgaccctgggcctgggcgcccacctgccctacctgatcagcatggcgctgatggtttccggcgtcggcaccttcattcaggcgcgtcggccgttcggaatcggcgcggggataatctgcctgcaaggcaccagctttgccttcctcggcgcggtgctgtccgcgggttttctggtcaagcaacggggcggcagcccggaagacatcctggcgatgattttcggcgtgtgctttttcggcgcggcggtgcagatcgtcctgagccgcttcatcggccaattgcgccgggtcatcacgccgctggtcaccggcatcgtgatcaccctgatcggtgtcagcctgatcaaggtcggcatcaccgacctgggcggcggcttcaatgccgcggatttcggcgcgccgggcaacctggcgctgggcctgctggtgctattgaccatcatcctgctgaaccgctcgaacacgccctgggtacgactgtcggcgatcatcatcggcctggccctgggcagcctcgccgcctggttcagcggcaagctggtgccccaggcgttgcccgacctgccgctgatcagcctgccgacgcccttccgcttcggtttcagcttcgactggacggcgttcctgcccgtggcgctgatctacctgatcagcaccctcgaaaccgtcggcgacctgaccgccaactgcatgctcgcccgccagcccatcagcggcccttcttatataagccggctcaagggcggcattctcggcgacggcgtcagctgcatgatcgccgcgaccttcagcgccttccccaacaccaccttcgcccagaacaacggggtgattcagctgaccggcgtcgccagccgtcatgtcgggctgtacatcggcctgttgctgttttgcctgggcctgtttccactgatcggcgcggtgctgcagcaaatccccaagccagtgctcggcggcgccaccctggtgatgttcggcagcgtcgccgcggccggcgtgcgcatcctcgcccaggcaccgctggaccggcgcagcatgctgatcatcgccacctccttcggcgtcggcctggggatcgcggcgcaaccgaacctgctgcacctgttgcccaaggtggtgcagaacctgttcgactcggcgatcaccagcggcggcctgaccgcgatcctcatgtgcctgttgctgccggaagatcgagccgcgctgcgtagcgcaaatccggctcgcgaaagcgacaccctggaaccgctttgagggttttctgcccattaagacttgtctgaggcctgtgggtgcgctatcaacgcactggttgcacccacagaacagctcggaaatgcctatgacccttgaagtcccagcccacgccggccctcaaaccgccaagcccgccagccgtattcgtcagaaaaacgaagaagcgatcatcaaggccgccgaagacgagttcgcccgtcacggtttcaaaggcaccagcatgaacaccatcgcgcagaatgccggcctgcccaaggccaacctgcattactacttcaccaacaagcttgggctgtatgtcgcggtgctgagcaacatcctcgagttgtgggacagcaccttcaacaccctgaccgccgaggacgacccggccgaagcgttgacccgctatatccgcgccaagatggagttctcccggcgccagccgcaggcctcgcgaatcttcgccatggagatcatcagcggcggcgaatgcctcagcgaatacttcagccaggactaccgcgcctggttccaagggcgcgccgcggtgttccaggcctggatcgacgccggcaagatggaccccgtggacccggtgcacctgatcttcctgctgtggggcagcacccagcattacgccgacttcgccacccagatctgccgcgtcaccggtcgcagcaagctgaccaagcaggacatggaagacgccggcaacaacctgatccgcatcatcctcaagggttgcggcctcaagcctgccttataaagaacccaacgcatgccctttaccctcgccggcctttgcgaataccgcgaagagattcgcaaaagccgctttatcgcccttgccgcgccaatcagcagcgcggccgaggcccaagcctttatcgaacggcacagcgatcccaatgcctcccacaactgctgggcctggaaactcaccgagcaataccgcagcagcgacgacggcgagcccggcggcaccgccggccgcccgatcctcgcggccatcgaagcccaggactgcgaccaggtcgcggtgctggtgattcgctggtacggcggcattcagctgggcaccggcggcttggcccgcgcctatggcggcagcgccaacaagtgcctgcaaggcgccgaacgcatcgagttggtcagccgtgtagccctgagttgtgcctgcagcttcagcgaactggcactggtcaagctgcgggtcgccgaactcggcgggctgctggtcgaggaacacttcacggccaacggcgtagaactgcaactggccctgggcgaaagccagatcgccaccttgcaaagccagctggccgacctgagtcgcgggcgcatcctcttgcagcgctgagcgcaccaatacgcaccaacgcctcgaaatcatcctgtgcacaacggcccggtggatagccgacttgcccacacctgctgtgcacccgactgtggataacctgagcacacttgcctgtaacccttctgtcacgtggctttgcagcgattgctcatttttcagccaatcactcaccaaaaacatatttttcaagataaaacagtaagttagcgtggtttatcgcttttagaagaaagccacacagtgcttatgcccggccttcgggcttgcacacaaatactgtggaacaagctgtggataacccgtgcaaggctgcgccagccgcatagagcgcaaggcttgcaggcacctgatcatttttcgaccagacccttcgggcaaaaccgccgccttttcaagcaccttgccctgaactggtgccgagcagcagtgcaggtaacgagcaaagggggcacgaggccgcagttcatcggggctccggcaatttcctgactcactggccaggaaattgctttgtccaccggcataacgttcagcaacccgagtccgtcatgccaaaccctgtacccatccccgctgcaataccccgcctgcaactgcgcggaatcaccaaacgctaccccggttgcctggccaacgatgggatcgacctgagtatccagccgggggaaatccacgccctgctcggtgaaaacggcgccggcaaaagcactctgatgaaaatcatctacggggtgacccagcccgactcgggcgaggtgatctggcaggggcagcatcagctcatgcgcaatccggcccaggcgcgcagcctggggatcggcatggtgttccagcatttctcgctgttcgagaccctgaccgtggcgcagaacatcgccctggccatgggcgccgcggccggtacgccgaagcagctggagccgaagatccgccaggtctcgcagcgctacggcatggccctggagccggaacgcctggtgcacagcctgtccatcggcgaacgccagcgggtggagatcattcgctgcctgatgcaggacatccgcctgctgatcctcgacgagccgacctcggtgctgacgccccaggaagccgacgaactgtttgtcaccctgcgccgcctggccagcgagggctgcagcattctgttcatcagccacaagctcggcgaagtccgcgccctgtgccacagcgccacggtgctgcgcggtggacgggttgccgggcactgcatacccgccgaatgctcggaccaggaactggcgcggctgatggtcggcgaagccgcgggcctgatcaccgattacccgaaggccaagggcggcgaggccttcctgcaggtacagaaactctcctggcccaatccggacccgttcggctgctcgctccaggacatcgacctggacgtgcgcagcggtgaaatcgtcggcatcgccggggtcgccggcaatggccaggacgaactgttggccctgctcagcggcgaacagcgccttggccgcgcccaaggcgccaccctgcgcttcgccgggcaagccatcgcccacctgcgccccgacgcccgtcgcgggctgggcctggcgttcgtcccggccgagcgcctgggccacggcgccgtgccggaactgagcctggcggacaacgccctgctgactgccttccagcaagggctggtgagcaaaggcctgatccagcgcggcaaggtgctggccctggccgaagacatcattcgccgcttcgcggtgaaaacgccggacagccagaccgccgcccgcagcctgtccggcggcaatctgcagaaattcatcctcggccgggaaatcctccagcgccccaggctgctgatcgccgcgcacccgacctggggcgtcgacgtcggcgccgccgcgactatccaccgggccctggtggccctgcgcgatgcgggcgcggcgatcctggtgatctccgaagacctcgatgaactgttccagatcagcgatcgcctggcagccctgtgcagcggtcgcctgtcggccctcaaggccaccgcggacaccagcctggtcgaagtcggcggctggatggccggccagttcgatacccccgtccacttatccgctcagccagcgtaacggagctgtttatttatgctgctttctctcgaaccccgcggccagcaatcgcgcctgatgctctggtgctcgccgctgttggccgcggccctgaccctgggctgtggctcgttgctgttcgtcgccctgggccacgacccgctggaaaccctgcacaccttgctgatcgccccgatcagcgacctgtatggcgtctccgaactgctggtcaaggccctgccgatcctgctctgcgccctcggcctggccgtggcgtatcaggcacggatctggaacatcggcgccgaaggccaactgctgctcggcgccctggccggcagcgccctggcggtgaacatcatcgacctgcaaagccgctgggcgctggtgctgatcctgctcactggcaccctggccggcgccgcctgggccggcctcaccgcctggttgcgcacgcacttcaacgccaatgaaatcctcaccagcatcatgctcaactacatcgccctgaacctgctgctgtactgcgtgcacgggccgctgaaagacccggccgggttcaacttccccgagtcggcgatgttcggcgatgccagccgcctgccgctgctcctggaagacggccgggtgcatgccggggtgtatttcgccctgctggccctggtggcggtgtgggtgctgctgcaaaaaagcttcgtcgggttccagatcaaggtgctggggctggacaagcgcgccgccggcttcgtcggttttcgcgagaagcgcctgatctggctggcgctgctaatcagcggtgggttggccggcctggccggggtgtgcgaagtcaccggccccatcggccagctggtgccccaggtatcgcccggctatggctatgcggcgatcaccgtggcctttctcggccgcctgcaccccatcggcattctgttttccagcctgctgatggcgctgctgtacatcggcggcgagaacgcgcagatgagcctcaacctgccgcaagccatcacccagttgttccagggcatgatgctgttcttcctgctggccagtgacgtgctgattctctatcggccgcgcctgaacctgcgttgggcacgtcgcgccgccaacccttccgtacaggcaggagcgctgtgatggatatcgatctgttgagcaatattttctacgccatgatccgctgcggtacgccgctgctgctggtggccctgggcgaactgatctgcgaaaagagcggcgtcctcaacctcggccaggaaggcatgatgctgtttggcgcggtgatcggttttatcgtcgccctgaacagcggcaacctgtggctcggcgtactgctggcgatgctcgccgggatgctgctgtcatcgctgttcgccctggtggcgctggtgttcaacgccaatcaggtggccaccggcctggccctgaccatctttggggtcggactgtcgagcttcgtcggcgccagttgggtcggcaaaccgctggccggattcgagccgatggcgattccgctgctgagcgaaatccccttgatcgggcgcatgctgtttgcccaggacctgctggtctacctgtccttcgccctgttcgccctggtggcctgggtgatcctgaaaagccgggtcggcctgatcatccaggcggtcggcgaaaaccccggcgcggccagcgccatgggcctgccggtgctgcgggtacgcaccctggcggtgctgttcggcggcgccatggccggcctggccggggcttacctgtccctggcctacacaccgatgtgggcggaaaacatgagcgccgggcgcggctgatcgccctggcgctggtggtgttcgccagctggcgagtgtggcgcctgctgctcggcgcctacctgttcggcctcgccagcatcctgcacctggtggcgcaaggcctgggtctggcgatcccttcgaacctgctggcgatgctgccgtacgccgcgaccatcctggtgctggtgctgctgtcccgggatgcgctgcgcacccgcctgtatgcgccagtgtcgctggggcagccgtggcaggcggggcgataggtggcgttcgggcgggcgttatcgcaggcaaacctcgttcctacggaatctctggcaaggggtcgaggcgtctgtccggctcgcgaaccggccacaactgcgccaccgcccaggccagctcgaataacaggatcacgccgatcaaggccgtgccgccctgggccagggcgtagacctgccaggtggcgaacagcagccggccggcggcgtcgtagcgtccgaaggccagctgcggatcgcggatgcgcagcaccgaccacacgcagacgatcgagcccatcagattgaccatcagcatgtgcatgggctcgaacggcggcagtgccccgggcaggtcgagggcccggctccactgctgcatcaggccgtgcagggcgagaaagctccagggggtgacaaaggcggcggtgacgatcaggtcgtaccaaccgctggcccgcaccaattgacggtattgcgctgtgctccacataaaggatcgctccggatattcaaggagcacacaagctaaagcctggagtatgctccagggtcaagcccttccgagacgccagcatgcgcatcggtgaacttgcccggcctgcgccttcagccgcggcgagattggcagcagcgttgccgcgatctggcatgccagcgatccggacagcgccgtgactcaactgctgcaagacaaactgcccctgatcgagactcgcatcagcgaactgggcgagttgcgccaggagctgcgacaacggctcggccagcgttatccattaaatccatgatcttcactcatcaaggaatccccgcatgtctacgccaaaaaccgcactgatcatcggcgcctccagaggcctgggcctgggcctggtgcaacgtctgctggacgatggctggcaggtcaccgccaccgtgcgcaacccgcaaaaagccgaggcgctcaaggccctgggcccggtccgtatcgagcaactggacatggacgaccagcaggcggtgatcgccctgaaccagaagctcaaaggcgaagtgttcgacctgctgttcgtcaacgccggggtcaaagggccggacgaccagacgccgggcaaagcgaccctggcggaagtcggccagctgttcttcaccaacgccgtggcgccgatcaacctggcccagcgtttcgccccgcagatccgtccggacaacggcgtgctggcgttcatgagttcggtgctaggcagcgtgaccatgcccgacgcgccggagctggcgctgtacaaggcgagcaaggcagcgctgaactccatgaccaatagcttcgtcacccagctcgagcagaagctcaccgtgctgtcgctgcacccgggctgggtgaagaccgacatgggcggcgaaggcgcggacatcgacgtcgagaccagcacccgcggcctgatcgagcagatcaatgcctataccggcaagggcgggcaccatttcgtcaactacaagggcgaaaccattccctggtaagcctgcacctgtagcagctgccggaggctgcgataaggcgcgaagagccttcccgcggccgacatcacagcgcacacggtgcgtggtcgaacgcagccttcggcagcggctacaggacgtcatcgcgggctaaccttgcgcctacggaggacgagctggccggcgatagaccgcaacgcggtctcgccgtaaactgcaccccgcgtcgatcctgacgcccctggatcagcagacagggcaacactgagctggctaacctgaacccactttcagaggagccggccaccatgcctgcgacccgtacctggttaaagaatcccctcgccattttcactggcaatgccctcgacgcccgtggcggcctggtgctgcaagacggcctgatcgtcgaagtgctcggcgccggccagcaacccgcccagccctgcgcacaggtcttcgatgcccgcgagcatgtgctgctgccggggctgatcaacacccatcaccacttctatcagaccctgacccgcgcctgggcgccggtggtcaaccagccgctgttcccctggctgaaaaccctgtacccggtctgggcccggctgaccccggagcaactcgccctggccagtaaagtggcgctggccgaactgctgctgtccggctgcaccaccgccgccgaccaccactacctgttccccgaaggcctggaaaacgccatcgacgtgcaggtggccagcgtgcgcgaactgggcatgcgcgccatgctcacccgcggctccatgagcctcggcgaagcggatggcggcctgccgccgcagcagaccgtgcaacagggcgaggtgattctcgccgacagccagcggctgatcgccgagtaccacgaacgcggcgccggcgcgcagatccagatcgccctggcgccctgctcgccgttctcggtaaccccagagatcatggccgccagcgccgaactggcggcaaaactcgacgtgcgcctgcacacccacctggcggaaaccctcgatgaggaagacttctgcctgcaacgtttcggcctgcgcaccgtggactacctggacagcgtcggctggctcggcccacggacctggctggcccacggcatccatttcaacccggatgaaatcgcccgcctcggcgccgccgggaccggcatctgccattgcccgagctccaacatgcgcctggcctcgggcatctgcccgaccctggaactgagcgacgccggcgcgcccgtcggcctgggcgtggatggctcggcctcgaacgacgcctcgaacatgattctcgaaacccgtcaggccctgtacctgcagcgcctgcgctacggcgccgaaaagatcaccccggcgttggtgctgggctgggcgacccagggttcggcacggctgctggggcgcagcgatatcggcgagctggccgtgggcaagcaggccgacctggcgctgttcaagctcgatgagctgcgcttctccggcagccatgatccgttgtcggcgttgctgctgtgcggcgcggaccgggcggaccgggtgatggtcggcggccagtggcgggtgatcgacgggcaggtcgagggtttggatgtgcggggcttgattgccgatcacagccaggcggcgcggaagttgatcggcggcgcctgatccggcgttatcgcgagcaagctcactcctacagggaaccggttccgatcatttccagaatgaatcacgccagatgtaggagcgagcttgctcgcgatgctcttcaaagacccaacagcgacaacatgatgaaggtcgcgaacagcacgaagtgagtcatgccttcgatggcattggtctcaccgtcgttgaggttgatcgcgctgacaatcagggtgatgaagatcatcaccgtctgcaccggggtcatcgccatctggaacggctggccggtgtagagcgccatcgcctccatcaccggcaccgtcaggatcaccgtcgacaacgacgcgcccaacgcaatgttgaccaccgactgcatgcgattggctaacgccgcgcgcagggccgtgaggatttccggcgccgcggaaatcgccgccaccaggatcgccgtgatcaccggcggcgcgcccgtgccttccagccccaggtcgagggtcttggacatcacctccgccaaggcgccgatcagcaccacgccgaacaccagggtggcgatggaaaacgccaggctgacaggcgccggctgatcctctgtcggttctttcttgcggcgtttttccgggtagctgtagctgaagaagtagctgtgggcgccgacctgcatgcgcaggaacagggtgtacaacagcaccatggcgccaatggtgaaggccgagtagagcttccatttcgactcgggaatgaactccggcaccaccatcgacacgcccatggcggtgaggatcatcacgctgtaggagcgcgccgagtcgtcgttgtaggcctgctcgccatgcttgatcccacccatcagcgcggccaggccgaggatgccgttgatgtcgagcatcaccgccgaatagatggtgtcgcgcaccagggtcggcgaggcctcgttgctcatcatgatcgccaggatcaccacctccaccaggaccgcggccagggtcaggatcatggtgccgtaggggtcgccgaccttctccgccagcagttcggcgtgatgggcgacgcgcatcgaggccgcgacgataaaaccgatcagcaccaacccggagatcagcgccacgccctggccgctgttgagcagcgcatgctccagcggataggcaaccagcgccgcgagcagcgccagcaacagaaaactttcttgcttgagtgaagtgaacattgcagtcctttgaccggataaatcgagcagaaagagatgagctaaagactgcctgaagtcactaacgtttcgttacaccttagtgcaccagtcaatggcgttgatgggcgagggtgcaccgggatgagcctttggtgatccggcgggcctcttcgcgggcaagcctcgcgcctacaggatcatgcagcctctgcaggcgcgaggcttgcccgcgaaggcttcaccctggtcccggagattttgttgtcctgttggtcagctatttgcattgagccattcaagccttagagcccagccacgccccacaacaaaatggagtccggattcatgcataaacgtccgttgcaaaaactgctgtgcgccctcaccgcggccatcggcctgagcgtctcgctgggcgccagcgccgccgatccgttgaaggtcggcttcgtctatatcggcccgatcggcgaccacggctggacctatcagcatgaacaggggcgcaaggcgctggtggagaagttcggtgagcagatcaagaccaactacgtggagaacgtcgccgaaggcgccgacgccgagcgggtgatccgtaacatggccaaggataagtacgacctgattttcaccacctccttcggctacatgaacccgaccctgaaagtcgccaagcagtttcccaaaaccaccttcgaacacgccaccggctacaagcaggacaagaacctcggcacctacctggcccgcacctatgaaggtcgctacgtcggcggtttcctcgcggcgaagatgaccaagagcaagaaggtcggctacatcgcctccttcccgattccggaagtgatccgcgacatcaacgccatccagctggccctgaacaaatacaacccgggcaccgagatcaaggtggtgtgggtcaactcctggttcgacccgggcaaggaagccgacgccgccaatgccctgatcgaccagggcgccgacgtgatcttccagcacaccgacagcccggcgccgatccaggccgccgagcgccgtggcgtgtacgccgtgggctacgcctcggacatggcccacttcggcccgaaagcggtgctgacctccatcgtcaataactggggcccgcactatatccaggccacccagggcgtgctcgaccacagttggaaatcccaggactactggggtggcttgaaggagggcacggtcgaactgccgatcagcgacctggtaccggccgacgtcaagcgtgaggccgagcagatcatcgccgacatcaagagcggcgccttccacccgttcaccgggccgatcaaggaccaggccggcgtggaaaaactcgccgccggggtcagcgccagcaatgcagagcttgcgtcgatgaactattacgtggaaggcatgaaggccgacattccgaaatgactcatcgaatcctgtagccgctgccgcaggctgcgctaaggtccgaaggacctttgctcgatctccagagcacacctccttcgtcggagtgccgcccagatcgatcgcagcctgcggcagcggctacagggcagtgggtaccttgagagcatttatatgaaccagctgccaatcatcgacatcagcccgctctacggcaacgacgcccaagactggaacagcgtcgcccagaagatcgaccgtgcctgccgcgagtgggggttcttctatatcaagggccacccgatcacctccgggcgcatcggccagttgctcgacgccgcccggcatttcttcgccctgccggccgccgagaaactcaagatcgatatcacccagacccgccaccatcgcggctatggcgcaatcgccaccgagcaactggacccggacaagccaagcgacctcaaggaaaccttcgacatgggcctgcacctgccggccgaccatcccgaggtgctcgcggaaaaaccgttgcgcggcagcaaccggcacccggatatcaccggtctgggaacccctgatggagcagcactacctggacatgcaggccctggcccagaccctgctgcgggccatgaccctggccctgggcatcgagcgcgattttttcgaccgccgcttcaaggagccggtcagcgtcttgcgcctgatccattacccgccgcggcacaccgccagcagcgacgaacagcaaggcgccggcgcccacaccgactacggctgcatcaccctgctctaccaggacagcgccggcggcctgcaggtgcgcaatgtccagggccagtggatcgacgccccgcccatcgagggcaccttcgtggtcaacctcggcgacatgatggcgcgctggagcaacgaccgttaccggtcgacgccgcaccgggtgatcagcccgctgggggtggaccgctactcgatgccgttcttcgccgaaccccatccggatacccgcatcgaatgcctgcccggctgccaggatgccgggcatccgccgaagtacccggtcaccacctgcgccgaattcctcttgtcgcggtttgccgatacctatgcctatcgccgggaaccgcaagcgtcctgaccgcccgactggtcaggttttaccgaatcgtccgcgtgcgcctgtagaatgcctgcccttatgggcgcgattggaacctgacgcgcccgcgcagccctggggaaacccggggccggcgcctgtcatcgaaccttgcggtgggcttttcgccgcaggatgatggagcgcaatacgttcacgcagcgctcgactgcacctgatgagatcacacccatgtacgactggctgaacgccttgcccaaggccgaactgcacctgcacctcgaaggatccctggagcccgagctgctgttcgccctggccgaacgcaacaagatcgccctgccctggagcgatgtggaaaccctgcgcaaggcttatgccttcaacaacctgcaagagttcctcgacctgtactaccagggcgcggacgtactgcgcacctcccaggatttctatgacctgacctgggcctacctgctgcgctgcaaagagcagaacgtcatccacaccgaacccttcttcgatccgcagacccacaccgatcgcggcattcctttcgaagtagtgctcaacggcatcgccagtgcgctcaaggatggcgagcagcaactgggcatcaccagcggcctgatcctcagcttcctgcgccacctgagcgaagacgaagcgcagaaaaccctcgaccaggcgctgccgttccgcgaagcctttgtcgcggtcggcctggacagttcggaaatgggtcacccgccgagcaagttccagcgggtgttcgatcgtgcccgcagcgaaggtttcctcactgtcgcccacgccggtgaagaaggcccgcccgagtacatctgggaagccctcgacctgctgaagatccagcgcatcgaccacggcgtgcgcgccttcgaggacgagcgactgatgcagcgcatcatcgacgagcagatcccgctgaccgtctgcccgctgtcgaacaccaagctctgcgtgttcgatcacatgtcgcagcacaacatcctcgagatgctcgagcgtggggtgaaggtcacggtgaactccgatgacccggcctacttcggcggctacgtcaccgagaacttccacgccctgtacacccacctgggcatgacccaggaccaggccaaacgcctggcgcagaacagcctggatgcgcggttggtcaagccgtaaaccgccatcgcgggcaacctgcccgcgatccccctgtagccgctgccgaaggctgcgctcgaccgcgaagcgggcgccgctcttgagggcctcgaaaggttcttcgaaccttatcgcagcctgcggcagcggctacagatcaaacgccgacttcgctcaactcttccagcgtcttgccccgggtctccatcccgaaccacccgaccacgccgcgaccgcactatgtagccgctgccgcaggctgcgctcgaccgcgaagcgggcgccgctcttgagggcctcggaaggttcttcgaaccttatcgcagcctgcggcagcggctacagatcaaacgccgacttcgctcaactcttccagcgtcttgccccgggtctccattccgaacagccagaccaccgccgcggcgaccgcgaaacacagcgcgcccagggcgaacaccccaccctgcccggtcatcgggaacaccacgccggtcaccaaaggaccgagcagcgacccgatgcgccctaccgccgaggcgaacccggaaccggtagcccgcgccgaggtgggatacaactcaggcgtataggtgtagagcaccgcccacatgccgaacaggaagaactgcatcaacaggccggagctgatcagcagcgccacgttgccgccgaacaccgcgctctgcccgtagaagaacgccatgaccccaccgcccagcaaggtgatcacgcataccggcttgcgcccccagcgctccaccagccaggcggccatgaggaagccgggaatcccgccgagggaaatcagcaccgtgtagtacaccgactgggtcacggcgaaacccgactgctgcaacaaggcactgagccacgacgtcaggccataaaaacccagcagggcgaagaaccacacactccagatcatcatcgtgcgctggcgatagagcggcgaccagatctcgcgcaaggccgaaaagaagtgccccggcacgctttccacccgcggcaggcgcaccggctcgggcaggtccgcgcgctgcaacgaggcgcggaccttatcctcgatccgccgcaacacctggtcggcatcggcgtgccgcccggcctgctccagccagcgcggcgactcggggatgaagaaacgaatcgccagcacgaacaccgccgggatcgccaggaccaggaagatgtcgcgccagccgatcagcggcagcaggaagtacgaaagcacgcccgccgcgacaaaacccagcggccagaagccgtccatcaaggcgatatagcgcccgcgccgcttggctgggatcatctccgagagcatcgactgggcgatgggaaactccatgcccatgccgatccccagcagcacccggaacagggtcaggctgtccaccgtctgcgccgtggagcacaggtaactggcgatgccccagagcacgatgctccactggaacaccggcttgcgcccgaagcggtcggcgagcatgcccgacagcgacgcgccgaccaccatgccgaagaagctcgaactggccagcaggccggcctgggccgtgctcaggccgaactcggctttgatcgagccgagcaggaacgtcatcatcgccaggtccatggagtcgaagaaaaacgccagggcgatgatgatgaaaatgacccggtgataaccgctgatgggcaaacgttccagacgctctgccgcactgtatccctgacttgccatgccccgtccccccgattgaatggtctgcaatcgagtgtgcaagatcgacgccgccgctcagtgctggatgcgacctgcccgcacccggcaacgacgccgctggccagggtcagtgatcggcgtgggtgggcttggggtaatgcgcggaaacttcagcgcagcgcgcctgcaacatgtcccgcagcagcttcaccggtttgctcagttgcgcccgatgggcgcacaacaggttcagcggtgcccattcgcagcgcagctccggcagcagcaccttgagccgcccggccagcacatcggccgccacgtcgagccaggacttgtaggcgataccccgccccgccaccgcccacaggcgcaccacatcggcgtcgtcgctgaaacgatcgccgctgaccgtcaggccgacctcgcgcttgccgtcgtgaaaactccaatgatcatgcacccggctgccgagcatgtagagcaggcaattgtgctgggccaattgctccagctgacgcggctcgccgtggcgggccaggtactcgggggcggccaccagcacccggcggttctgcggcgcgaccggcaaggccaccaggctggaatcttccggttcgccgtaacgcagggcgatgtccaccggctggcgaaacaggtcggcgatacggtcgcccagcagcaggcgcagcgtgagtttggggtgctccagctggaactggtcgagccagggcagcaacagattgcggccgaaatccgagggcgcggacagctggagaacgccgctgacctgatcctgcccgctggccagcaggcgccggccttcctccaggttgctcagggccgcgcgagcgtattcgagaaacccttcgccctcggcggtcaggcgcaggctgcgggtcgaacgcgccagcagccgggcgccgagctgctgctcgatacgcttgagggccgcgctggccaccgccgccgacaggtccatgacccgcgccgcggcggacaggctgccgaggtcggcggcgcgcacgaacaattgcaggtcatcgaatcgcagcatctggctcaccgggcattatcaaaaaaatattgaaagagactgctgttttagccggttttatcttccggggaaatggccaatgctcgccctaccgtcatatcagctcgtcacgccagcctttgaaggaactccctatgtcgcaagcctttaccgtcatcgccaccctggtcgccaagagcggccagcaggccgtgctcaagcgcgaactcagcgccctggtgcaaccgagccgtgaagaagccggctgccagtactacaacctgcaccaggacgccgaagccccaggcaccttttatgtactggagcgctgggacgacgaggcggccctggaatttcacaacgccacaccgcacttccagcattttctcaaccagacccgcgaggcgatcgagcacttcgagctcaagcgcctgctgctcctctgacccaaccttcatcttcatcaggaaaacccaccatgaaagctatcgcctactacgcctccctgccgatcgacgatcccctgtccctgcaagacatcgaactgccggaaccgctcgccggcccccgcgacctgctggtggaagtcaaagccatctcggtcaacccggtggacaccaaggtccgccagaacgtccagcctgaaggtggcgccgccaaggtgctgggctgggacgtggccggggtggtcaaggcggtgggcagcgacgtcagcctgttcaaggccggtgacaaggtgttctacgccggctcgatcgcccgcgccggtggcaacagcgagctgcacgtggtcgacgaacgcatcgtcggccatatgcccaagagcctgggcttcgccgaagccgccgccctgccgctgaccgcgatcaccgcctgggaactgctgttcgaacgcctgcagatcgccgaaggccaggccgatcggcagcagagcctgttgatcgtcggcgcggccggcggcgtcggttcgatcctcacccaactggccagccagctcaccgggctcaaggtcatcggcagcgcctcgcgcgccgaaacccagggctgggtacgcgagctgggcgccgacctggtgatcgaccatagccagccgttgagccaggagctgaagaaagccggccaggccagcgtcacccatgtcgccagcctgacccagaccgaggcgcacctggacgaactggtcgaggccctcgcgccccagggccggctggcgctgatcgacgatccgcaaaccctcgacgtgaccaagctcaggcgcaagagcctgtcgctgcactgggagttcatgtacacccgctcgctgttcgaaaccgcggacatgcaggagcagcacaagctgctcaatcgcgtcgccgagctgatcgacgccggcaccttgaagaccaccctcggcgagcacttcggcacgatcaacgcggccaacctgcggcgcgctcacgcgttgctggaaagcggcaaggccaagggcaagatcgtgctcgaaggcttctgaagcggggagcggacggcgtcctgcccgcgctaaaaaggggcaggatgccgtcagtccgacagttgatccttgtcatacttgtgaccgtattcgggtctacactgggggcctttgcaatgcagtcttttacgcgaggaggtcagcaatgaagatcctgataaaagaattggcaaaatccaaaggcacccaatggcaggttcaactcgaccagcatgcggtgaccttccgcagcgaggccgaagcccgagccttcgccaatacgctggaaacgcgtctgcaagccccccaccgcttccccgaaagccaacaacgcgccgccggctgattacagctgggcggcttgcagtgccctggcgttctgcaatttgcgggtgaccatcgccagcgtcaccaccagaatcccacacaggctgatgaccgttgccatcggcacggcactgccatcgtgcaacacgcccaccaacgccgcggcgccggccgccacgctgaactgcaggcagccgagcatcgccgaggcactgccggcccgcgcgccctgaccgttcatggcgcaggccgaggcattgggaaggatgcagcccaggctggcgatacaaatgaacagcggtgccagcagcggccagagttgtgccgggtgcagcgaactgacggcgagcaaggccaggccacccaacaggtagatccacaccgtgcgtgccagcaggaaggccgggccacgcttggccagcaaccgcgcattgatctgcgccaccaggatgaagccgccggcgttgatcccgaagaaccagccaaaatgctcggccggcacaccgtagagtttgatgaagacaaaaggcgaaccggcgatgtaggcgaacatcccggcgatggcgatgcccccggtcagggcatggccgaggaacacccggtcagccagcagccgaccgtactggcgcaaagcgccggacaacggctggcgcggcacatgggccggcaggctttccggcaagcccagcgctaccgccaggccggccagggcgctgaacaaggtcagcatgatgaagatcgactgccagccgtagagattcaccagcaggccgccgagcatcggcgccaggatcggcgccaggcccatgaccagcatcagctgggaaaacaccttggccgaacccaccgcatcgcacttgtcgctgaccaccgcccgggaaatcaccatgcccgcgcagccaccgagcgcctggacgaaccgcgcgccgatcagccattccaggttcggcgcgtaggcacaggccagggacgccagggtgaacagccccaccccagccagcaacgggatgcgccggccaaagcggtcggccaccgggccgtaggccagctggccgatggacaggccgaggaagtaggccgccagggtcagctgaacgtgtttttcatcggtgccaaaggccagcgccatcgccgggaacgccggcagatagaagtcgatggccagaggaccgaaggcgctcagggcgccgagaatcaggattgtgcgaaggttcatcaggcatccaggtgcgggtcggtcggcagcccgacagtttatccgcgcttggaggccttgaacattccgataggtcgctaactattaaaaagaccggctaaatccactcacgccagcttgaccgcatagccttcttcgctgatcaggctgatcacctcgtcggcggacaagcggctttccacacccacttcccgggccccgagatcgaccttgacgctggctgccgggtccttgctctgcaccgcctgggtgatggcccggacgcagtgaccgcaggacatcccttcgacattgaacacttgcatgacgcttctcctgtagtgagggttgtcgccagtctcgaccttgccatgatggcaaggtcaagttccggatgcatctgccgggctggcaatcggcgacgcgctcggccaagcttcacccctcaacgacacgacactaggagattcagccatgcgctggtcggttatcagcctgttcagcctcctcggcctgatcgcggcatccccttcggtcaacgccgccggtgaggactacggcgtcctgatcatttcccgggaacgcctggaagtcgccacgtcctgcgaaatcggcctgtacatcgaggaccagttggcgggccggctgttccaggaacaagccacgtccttcaacctgccgccgggcaaagtctcgctgcgcctgaaactgctgccggggcagatgccgggctgcaacccgggcatgctcgcgccaagctcccaggacattagcctcaaggccggcgacgtgctgaagttccgcatcgccatgagcccgtcgggcctgcacctccagcgcaccggcctgggatactgaggccccgggtcgtcgcctgcgccctgtccctccccggaaccggcacgggcgacgatccgggcgctaccccgagacagattgaagcaccccgcaccatggcgcttgaccttgccagcatggcaaggttgatcctgtagaccaccgtttacagggagtgtcagtgatgtccgaatcaaccacttttgacctgccgattgccggcatgacctgcgccagctgcgccgggcgtgtggaacgcgccttgagcaaggtcgcgggcgccgcggccgtcagcgtcaacctcgccaccgaacaggcccgtgtccaggcgcccagcgacagcctgccggcgctgatggccgccgtgcaggatgccggctacagcgtaccggcccacagcctggagctgaatatcggcggcatgacctgcgcctcctgcgtcggccgtgtggaacgcgcgctggtcaaggtggccggggtcacccgggtcagcgtcaacctggccaacgaacgcgcgcacatcgatctgctgggccaggtcgatagcgccgacttgatcgccgccgtcagcaaggccggctactccgccaccctgtggcaagccgaacaccccgagcgcgacgatcaggaacaacgcctgcggcgcgaacgctggtccctggtgctggcgatcctgctggccctgccgctggtactgcccatggtggtgcaaccctttggcctgcactggatgctgccggcctgggcgcagttcgtcctggccacgccggtgcaattcatcttcggtgcgcgtttttatgtcgccgcctggaaagccgtgcgcgccggcgccggcaacatggacctgctggtggccctgggcaccagcgccggttacggcttgagcctctaccaatgggccatcacccccgccggcggcatgccgcacctgtacttcgaggcctcggccgtggtcatcgccctggtgctgctgggcaagtacctggaaagccgcgccaagcgccagaccgccagcgccatccgcgccctcgaagccttgcgcccggaacgggcgatccaggtcatcgatggccgtgagcaggaagtggcgatcagcgccctgcgcctgaacgacctagtgctggtcaagcccggcgagcgcttcccggtggacggcgaagtggtcgaaggccagagccatgccgacgaagccctgatcagcggtgaaagcctgccggtgccgaaacaacccggcgacccggtcaccggcggcgccatcaacggcgaaggccggctgctggtgcggaccctggccctcggcgcggaaaccgtgctggcgcgcatcatccgcctggtggaagacgcccaggccggcaaggcaccgatccagaaactggtggaccgggtcagccaggtgttcgtgccggcggtgctggtgctggccctggcgacgctgatcggctggtggctgtatggcgcgccgctggaaaccgcgctgatcaatgcggtcgcggtgctggtcatcgcctgtccctgcgcgctggggctggccaccccgaccgcgatcatggccggcaccggcgtcgccgcccgccacggaatcctgatcaaggacgccgaagccctggaacgcgcccatgaagtcagcacggtggtcttcgacaagaccggcaccctgacctccggcacgccacgcatcgcccacctggatgcggtcgacggcgacgaagaccgcctcctgcaactggccggcgccctgcaacgcggcagcgaacacccgctggccaaggcggttctcgacctgtgcgccgaacgccagctggcggtggccgacgtcagcgccagccagtccctgaccggccgcggcattgccggcaccctggacggccgccaactggccctgggcaaccgacgcctgctggaagaaagcggcctgcaagccggcgacctgacggcctcggcccaggcctgggaaaccgaaggccgcaccctgtcctggctgatcgaacaacaaccgcaatcgcgggtgctgggcctgttcgcctttggcgacaccctcaaacccggcgccctgcaagcagtgcagcaactgagtgcgcgccatatcggcagccacctgctgaccggcgacaaccgcggcagcgccaaggtggtcgccgaggccctgggcattactgacgtgcacgccgaagtgctgcccgccgacaaggccgccaccgtcgccgaactgaaaaagaccggcgtggtggcgatggtcggcgacggcatcaacgacgccccggccctggccgccgccgatatcggcatcgccatgggcggggggaccgatgtggcgatgcacgcggcggggatcaccctgatgcgcggcgacccgcgcctggtgccggcggccctggagatcagccgcaagacctatgcgaagatccgccagaacctgttctgggccttcgtctacaacctgatcggcattccgctggcggcgttcggcctgctcaacccggtgctggccggggcggccatggcgctgtccagcgtcagcgtggtgagcaatgcgctactgttgaaaacctggaaacccaaagacctggaggacgcccgatgaacatcggccaagcagcccgcaagagcggcctgagcgccaagatgatccgctactacgagtccatcggcctgctccggccggcccatcgcagcgacagcggctaccgcctgtacggtgacgacgacctgcacagcctggcctttatcaagcgctcgcgggacctgggcttttccctggaggaagtgggcaagctgctgaccctgtggcaggaccgccagcgcgccagcgccgatgtcaaagccctggcccgccagcacatcgacgagctcaaccggaaaatcgccgagctggccgggctgcgcgacaccctgcaggacctggtgcagcactgccatggcgaccatcgcccggattgcccgattctcaaggacctggcctccggcggatgctgcacgcccccatgacctgtagccgctgccgcaggctgcgacaagggccgaaggcttttctggcggtttcaagagcagcgcctgcttcgcagtcgatcgcagcctatcggcagcggctacgtgattcacgggtacaaaaaatccggctattgccggatttcttgtattcgggaatcactgcatccagggcggaggcggtggttcctcggacttggccggtggcgcgtcgtcggccatgcgcatggcctggcgccgttcctcgtccaggcgcgccgcctcgatctcccgcagcacgccgccgacatccgccagttcttccggatcgtcgaactcgccggtcaacacgctggccgggtgcagggtgccggcttcgtacagggcccacatctccttggcgtagcgggtgcgtttgagctccggggcgaaacgcccgaagtaggacgccatgttgccgacatcccgctccagcatgctgaaggcgtggttgttgcccgccgcgtccaccgcctggggcaggtcgatgatcaccgggccgtcgggggtcagcagcacgttgaactcggacaggtcaccgtgcaccaggccggtacacagcatcagcacgatctgggaaatcaggaaggcgtgatattcgcgggcctgatccggctccagcaccacgtcgttcaggcgtggcgcggcatcgccgtattcatccgccaccagctccatcagcagcacgccttcgaggaagtcgaacggcttgggcacccgcacgccggcgttggccaggcggaacagggccgccacttcggcgttctgccaggcgtcctcggtctccttgcgcccgaacttggaccccttggccatcgcgcgagcctgacggctgttgcgcaccttgcggccttcctgatactcggccgcctgacgaaaacttcgtttgttcgcctccttgtaaaccttggcgcaacgtaattcgttgccgcagcgcaccacataaacagctgcttctttaccactcatgagtgggcgcagcacctcgtcgaccagaccgtcctcgatcaggggttcaatgcgttttggagtcttcatcagcttttatcaggggtcctttattaccaaacacgcgaatgtcactcgttatacggcaatcctcgcaccacggggagaggttaccgacctacgacagtgccgatgcactcaatgtgccaggtcaacccgtcatgtcgacagggtcgaccgaccaggatcatagcccagtgctcggcggctgcccgttactaaaggccggggtataggtgacagaagctggcgagtgcttcgcgctcgatcgcgagcaagctcgctcctacagggggccgccactgcgcaaacacctggcccctcagcgctcgacaatcgccgtcacgccctggcctccggcggcgcagatcgaaatcaggccacgcccctgccccgccacttccagcagcttcgccaggttggcgacaatgcgcccgccggtggcggcaaacggatgcccggcggccagcgagctgcctttgacattcagccggctgcggtcgatggaacccaagggcgcgtccagccccaggcgggtcttgcagtagtccgcgtcctcccaggccttgagcgtgcacagcacctgcgcggcgaaggcctcatggatttcgtagtaatcgaagtcctgcagtgtcaggccattgcgggccagcaagcgcggcaccgcgtagaccggcgccatcagcagcccttccgcgccgtggacgaaatccaccgccgccgcttcgccgtcgcgcagataggcgaggatcggcaagccacgttccttcgcccattcctcactgcccagcagcaccagggacgcgccatcggtcagcggcgtggagttgcccgcggtcagggtggctttgtcgccgcgttcgaacactggcttcaacgacgccagcttttccagggtcaggtccgggcgcaggttgttgtcgcgggtcaggccgaggaagggggtcatcaggtcgtcgtgccaaccctcggcataggcggcggccattttctgatggctctccagcgccaactgatcctgctcgtcgcggggaatgttccaggtttgcgccatccgctcgcagtgctggcccatggacaaaccggtccgcggctcgccattgcgcggcagttccggcttgaggtgccgggggcgcagttgcaggaaggtcttgagcttgtcgcccagggtcttgccgcggttggcttgcagcaggatcttgcgcagcccctcgttgacgccgatcggcgcgtccgaggtggtatccacgccgccggcgatgccgcattcgatctgccccagggcgatcttgttggccaccagcaacgccgcttccaggccggtgccgcaggcttgctggatatcgtaggccggggtggtcggcgacagccgcgagccgagcacgcattcgcgggtcaggttgaaatcccgggaatgcttgagcaccgcgccagcggccacttcgcccatgcgcaggccgtgcaggcggtagcgttcgatcaggccttccagggccgcggtaagcatggcctggttactcgcggtggcgtaaggcccgttggaacgggcaaaggggatgcggttgccgccgataatcgcaacacgacgcagctgagtcatggaaagctccctattctgtgagtggcacaaccgacaagcgtaggttgtatcgtgcggatcgaacgaccaaaggcccttaatggtccacactttgaacctcagttcctggagcgtgttccatgtcagatcgttacatcgacttcgccaactcgtccatcggccaccgcctggtcggggcccttggcctgccgtctccagtgcgtctggagcgctggcaggccggccgcatgcgtccagtcgagggtgcgctgctgatcggcggcggcccgctgacccagcaggtcggcgccatcgccccgcggctgaccgagagcatctacagctacggcaccgatccgaccctcgccaccgcctggattcccggccacggccccaagctcaaggccgtggtgttcgacgccagcgacctcctgcagaccgaccagctcaagcaactgcgcgaatttttccagccgctgatgaagaacctcgaacccagcgcgcacctggtgattctcggccgcgcccccgaaaccctgggcgatccgttcgccgccagcgcccaacgcgccctggagggtttcagccgttcgctggccaaggagttgcgcggtggtgccaccctgcaattgctctatgtcggcgagggtgccgaaagccagctggaaggcgcgctgcgcttcttcctctcgccgaaaagtgcttacatctccggccaggcgatccgcctgaacccctgcgcgacccaggtccaggactggacccggccgctggccggcgcgcgggcactggtcactggcgcggcgcgcggcatcggcgcctcgatcgccgagaccctggcccgggatggcgcccaggtggtgctgctggacgtgcccgccgccaagaccgacctcgaagccctggccgcgcgcctgggcggccatgcgatcaccctggatatctgtgccgaggacgccgcgacccggctggtggaacagttgccggacggcatcgacatcgtggtgcacaacgccggcatcacccgcgacaagaccctggccaacatgaccccggaattctgggacgcggtactggcggtcaacctcaacgccccgcaggtgctgaccaaggcgctgctggacagcggcaccctgcatgacaacggccggctgatcctgctggcatccatcagcggtatcgccggcaatcgcgggcagaccaactatgcggcgagtaaggccgggctgatcggcctggcccagtcctgggccccgctgttgcaagagcgcggcatcagcatcaacgccgtggccccgggctttatcgaaacccagatgaccgcgcacattccgttcgccctgcgcgaggccgggcggcgcatgagttcgctggggcaaggcggcctgccgcaggacgtcgccgaagccgtggcctggctcgcccagccgggcagtggcgcggtcagcggacaagcgctgcgagtctgtgggcaaagcgtattgggagcgtgaacatgagcctgcaatggcatgagctggataccccaccgaacctgcccgagctgtactggaaggccgcgatccgccgcaagatcaccggcaccgagctgcctgaatatggcctgcaccgccaggtgagcgtgcaaccggcgaagcttgcggcctatcgccaggtctgcggctttaccgagaacggcctgctgccgccgacctacccccatgtgctggcgttcgccctgcagatgcaattactgaccgccagggacttcccctttccactgctggggctgatccatctggccaaccgcattcgcgtactacggcccatgggtggggtcggcaacttaagcatcggggtgcgtgcggacaacgtgcagccccatgccaaaggcgcggttttcgatctgttgacctacgtcgacgacgccctgggaccgctatgggaagcacaaagccggatgctctgtcggggtgtgcaactgccgggcgaagcaccggccgaagagccgtcggccgaggccagcctcagcgagctgacgcgctggcaagcccccgccgacatcggccggcgttacgcccgggtgtccggcgactacaacccgattcacctgagcgccatcagcgcccgaatgttcggttttccccaggccatcgcccacggcctgtggaacaaggcgcggaccctggcggcattgagcgaacatttgccggcggcccctgtcgagattgccgtggacttcagaaaaccggtgcgcctgcccagcgaggtgtgcctgctggcaagcgccgcgggctcgagcggtgacctgcgcctgaccggcgcgggcgacctggaacatatgagcgggcactggcagccgctggcctgagcccgtctcaaccgcgacgaatcaggaacacgcccgccaggatcagcaccagcccggcaatcttgcccaggctgatgggtgcctcgcgaaaccccgcccagccgaaatggtccagcgccagggccatgcccaactgcccggcgagtaccagggccatgaacagcatcgcgccgatccgtggcccggcgaaggccgcggtggcaatgaaaaacgcccccagcagaccgccgcaccagtgccaccaggtcaggcttttcaaggccgtcaggccgggcacttcgcgctgggccatggccaggaccagcaaggccacggtaccgacaaaaaacgagatcagcgccgccagcacgctggaaacctgcttggccaattggccgttgattcccgcttgcaggggtaaaaaagcaccggcaatcaccggcaggcaaagcagccaccagacaggggcaggcataaagtttctccagaaaaaaagccaggccgcggattataagacaagttgacgccaaatccgtgacggggccgcaagacaattaattgtatatatataactttcgttcaagcgccctaagagttttcacttaaaaaacataatatactgattaataacatcttttaaaaaacacatgcgcttaccacaacctttggtattagtccctccgcgggagcaaaaacagccgatatataagttgttaataccaagttgagaatggtgaaaaaaagcacttggaccttttatagcgactacggacgaaaacatctccagcaacagaactggagagttatcgaagacaacaaaacgttgtaacaggtgcaaggaatctcactcatgaaaactcaagtctggttgaaaacaagcacagcgctggccctgatcctggccctcggcctgaccggttgcagcagcggcggtggcggccacaagagcagctccggcagctcctcgcccgacagcgcggcaggtaccgacagtggctctggcggctccggcgatggttcgggcggtgccggcggcaccggtggcggcaccgcgggcacaggcgggaccggcggaatcgatggcggaactgatggtacaggcgggatcggcggcggtacgggtggtacaggtggaaccggcggcggcactgcagggacgggtggcactggcgggaccggaggtactggtggcggcactggtggcggcaccgacccgaccaacccaacggatccgaccgacccgacaacacccaccactaccccgttggtcacctcgaccctggtgtccgacctcggcaccaccatcagcggcgtcggcgatggcgtcagtaacctcagcaacgcattgaccccgcttccggtagtcggtggtgtactgcagagcgcagtgaataccaccggcaatgtggtcgataccgtgggcgatggcctgaccaatggcctcggccaactgggcagcgatccacaggccttgagcaagaccacggccatagtcggcaacgtggtgtcggacgtcggcgatggcgtctcggacatcagcggcaagctggccaccagcaccagcagcattcccctggtgggcggtgtggtcaccaaagtggcgccggtactcgacggcgtcggcgacaaggtcagcatgctcggcgacaccctcaccaccgtgaccagtagcggccccctggggacagtgacagacaaggtcggcaacaacctgctggtgccggtcgtcaccctggcagaaggcttgaccggcaaggtggtcagctccacgggcctgagcgctccggtcggcggcctgatcgacaaggtggcaacgaccgtcgatggcctgggcgacaaagtcaccgccacgggcagtggcaacacgctgaccaataccctgggcggcaccctgaacaatgtcgccaccaccatcggcaataccagcagcctgacgaccgccccgagcaccggcgggggaaccattggcggcgccggcctgctggaaaccgtcggcggtgcggtggtcaacctgggtaccggcttgaatgccggcaacaccaacaccctggtcagcgccacaggggtaagcacagcctcggtcggcaacgtcgtagcctcggtgggcggagccctgggcggcacgggtgtggccaatgtcggcgccactgcgccgctggccggtgtcggcgccacggtcggcgcagcgttgaacccggtcaccacggccgtcaccggcctgacccagcaagtaggcgccacgaccggcaccggcacccccatcgccggtctgctcacccaggtaggcggcgccgtcagcggtgcgggtaccacgatcacggcaagcgcccctaaccctgtggtgacagccgtgggccagaccgtgaacaccctgggggccacggtcacctcggtcgggaccctggtcgacggtggcaccaccggcggcaccaccggcagcctcggtggtgtgctcggcgggctgaccgggaccttgagcggcacccgataagcgttttgcacctggccgattcgacggccctacctacagcgcctacgcttggttggagacgagggattcgattgagtctctcgtctttttcttgcctggagcatgacggttgcagtccttgatcaaggccaagaccctgacaagcgccgccgattgaagtacctctcgcgttgctgcgacttgaccatggagtgtcctatgcgcgctttggctcccttgctgttagtctcgctttgctcatacgtccacgccgaaaaccttcccagctttctcaatagcaacgaaaccatccgcaacctgccggtacccaacctgccggccgacgcctaccgccccacgaccccggcgcccaaactggcgccccccacggaaccccaggcccagcccctgatgatgggcaccacagtcaacgtcagcaccgtgcagatcgagggcggcaccctctatccgctgagcgagctggcagagatctacaagccgctgatcggccatgagagcaccctggggcaactgatcgaagccacccgggaaatcacccgccgctaccagcaggacggctacctgttgtcctatgcgttcctgccgcaacagagcttcgaccagggcaccgtgcgcgtggtcctggtggagggctacatcaaggactaccagctgcagggcgatatcggcccggtctcggcctacctcgccaaactggtggcaaaactcaaggccgaacggccgctgacccgcaagaccttcgagcactacaccaccctgatgagccgcattcccggggtcaccctgcaagcccaggtgccgccaccgggaaccaccgacggcgcggcctacctgattgcccaggccagccgcaaaccgttcaccagcagcctcagcaccaccgacgacaaccgcaatggcctgcaagcgctgctggcggtcagcagcaactcgcagacctccatgggcgagcaggtaaccctcagcggcctgttcccgccgggggacgatcacgagcgctactaccgcctggactacaaccagtttctcaatgacgaaggcacccagctgagcctgtacggcacgcgctaccgcgccgacccggggaccaatgtgcggctcgacaacggcctcgaactcaagccccaccgggagaacgaccgctattccataggcttgagccacccggtcatcgccgcgcccaacgagctgctgatcctgggttcgcgcctgtatgcggtcaacgacaagacccgctatcaagtggtcggttatccgcagagcgtcgaactgaaaaccgacattcgcgccctggccttcgagggcgactggcgcaaggccaacgcacgccaactaaggattctcagtgccggggtgtaccaggggctggacgccctgggcgcgaagaccaacgacaacctgtacgacctggacttcttccgtgtgcgcctgtccggcgtgcagagcgacaagttcttcgacaactggcaaggggtgctgtcggcggccctgtactggagccgcgacaacctgcccgacagcgagcgcgcggtgttcggcgggcagaacttcggccgtggctaccccgacgaccaggcgtccggcgacaagggctggggcgcggcctatgaggtgaactacagcttcaatcgcgaagaccgctggctgcgaatcctccagccgtacgtggtgctggatcgctcgcggacctggttcaacgaactgccggtcaagggtaacgacctgtcgtccgccgccgtcggcctgcgctttggcgacgccaagtactacaacatctccctcgaagcggccaagccaatgtccgatgaagcactggacacccacaaccggcgtccgcgctacaccctgagtttcagctaccagctgtaagcctccccacaaaacaggcacaacaaaacgacccgctcgcaggcgggtcgttttgtccgagcaacaatcagaataagcccggacgctctggtttctcgacctgcccatagacttaccaggccagattctttacggagcctctgtcggattcaagttcgaatatttcgtatagattttcggaaatgccttacaacacacctgctccgccctgcaataggattgttcggctgactaaaaggagtgtcacgtatggctaaccacggttacatgaccatcaccggcaagacgccaggactcatttctgcaggttgttcaacccaagactctattggtaataagtgtcaggcaggacataccgatgaaatcatgatgctgtcttacagtcacaacatggttaatatcgggaacattaataaaccaacacacagcccaatcatagtaaccaaaaacattgataagtcctcccactcatcgctcaagccctctcaagcagagaggaagtaaactgcactatcagcttttaccgagtatcgtcttttggcatgcaggaaaaattctactccgtttcgatcagtggtggagttattgccgacctgacacttgaagtgccccacgccctattgcagaacgatgctgaaccgctagagcatgtcgccattcgttatagggaaatcacctgggcccaccactctgccgggaccagtggacacagtacttggggaaacaacgaatgaggccaatagatgacaattgcacgcccagcagttgtgattactggctggtcagtgagcgaattttgaagccgatgtggcctatggaatgattgacttgagttcgtcagcctacgatataggtagaatggtattaaaacccgatacttggcgtttgtttaggtacgtgaatacggactatgttagagggtatcaacaagctacgcgaggaggctttatcttcgatagattgatggacagtgcgactgcaaaaaccatgtatagcgcgtgccatccttctaatgagtaactttattttctaccccatcttcgtgctgataacggtgcttctgtactggccttcctactgggcatacttcgcgttttcaggtcgaaatttttccccatttaagttctggggagttggtatctataacgtactgttcggctctattcacgttttttttgtgcaagacagcacgctaccatttgtggggcgcgtagataactccgtaatgggctggctatcccttgtcatgatatttgtctatgcgtttacccttccagctaattgggaacgaaaacgttggtattcacgaaagtgaactcacgccgaatcaatacccgaccaagagggtatttcaaagaggcaccctagttatccgcctacaggtcatcttctggattacgcagtggccctggaagaaagggaaactcagggactgaccaggtgaatgcgtggctgcgggaacagggtgttcagggtttccagcaggcgcacgtggtagatgggtttgcggaacaggtccagcacttgcaggcgcagcaggtcgctgacgtcatccatgtcggcatgacccgaggtgacgatcaccggcaggtgctggcgggaggtgtggtcgcgcaggcgcctgatcagcgacaggccactctcctccggcatgcgcaggtcggtgatgaccagcgcgatgtccgggtgttgagtgagatgggccagggcaagcttgaccgaggtcgcggtgaagcagcaaaagccttcaccttcgagcaattcggcgagctcgagcagagcgtcctcttcatcgtccacgagaagaagctgctggcgtggaaacgaagaggagctcatgggcaatacctgaaagtgactgaataccgatgggtatcgacgcctcgagaaagccttgaggaccggtgttacgggctaactaggaggagcagcagcggtggtgtcgttctccaacgcccctttcagagtctcaaaggtaccggtaatagcctccgatatgtcaggtacgaatgccgcaatggccacggccaccataccggcgataagcgcgtactcgatccctgacgccccctcgttattcttgagaaaacgcaggagccgggaggcctgaagggtgatccattgggtggcgagaatgaagaacatctggtttctcctcaacgcactgagtgttgcagcgttgcaacatgattcccctgtgccagcacagcattgtcaacaaacttccagccaacaactgtaagaacgaattaatcattaagtattaacttgtccctttggcgtcaaaaaaaacgcggcatcggacagggcacggataagccaagttattttctcgacagtaatggcgttttgttgcagctgttctaccttcaaatagcgaaatagttgcttgttcatagctgcctgattgcgaaattgactcattggatgtgcgagccggtaatgcagcgggaaagggagagccgtcatgaacagtcgtatcactatgggcttggctggggtgtttctggtgggggctctcattgccggttactggggcctggcattgagtcgcaggcccgcagcgcaacctgtagcgcagccttccgccgtcgtgcaaaccgtcgctgcttccgccgaagatgcgacacgccagcccgtcgcggtgctggttcgcgacatacctccgttcgttcccatcaaggccggcgatgtcacgctggagcggctgcgcaccgcccccgccggcagcctcaaaagtctcgatcaagtcatcggacgcacgccatggcgggcgctgccggcggggacctggctgagcgaggaaagcttcgaagccgggggcagcgtggcccgcatgatccgtgccgatgagcgcgccctggccgtcgcggtagacgaagtcatcggcgccagcgggcaactgagccctggcgactacgtcgatgtgctgctgttcctgcgccaggacagcaacaacctgctgccctcggcccaggtcgtggtgccggccctgcgggtgctgggcattggcgagcaactgggcctgaccaacgatggcaagccgggctcgccgcccgccagtgccgaggaaaagctcaaacaggatcagcgtcgcctgaacgcgcgcagcgtgttgctggctgtcccggaacccttgctgagccgcttgatgctcgcggctcaagccggcgtgctgcgcctggcggtacgcagcgccgacgagaaacgcttggcgcattactgggccggcgaaaaaagcgcatcgaagcatctgcaaaacgccgacaggtctctgatccagttcaaccagctggccctgtccaccccctctccctccaccggcagaacgttcgacgccgcagcgcgtcgcgcccagatagaagtcatacgcggcatcgaagcgagtcaacaaacaccctgatcatgcaaggacacctgttcatgtccaatgattcccggtccctgttcaaaggcctgatccggcccctgatgtcgaatggtgcgcctgtcgagagcgacgtatcgctgcgcaaccacgacccggacgggtacgcctcgtactccctgggaaaccgcaacttcaacaaacgcagtgggctatcgcaatgagtcagaacctgagccagaccttcctcgcgatcacccgcaacggcaccgacctggagtggttgcaaggtgccctggcgccactcgggcaggtggtcagcgctggcagcggcagcctcgacgaattgctggcgctggtggatgtgacattcgccagcctggtcttcgtcggtctcgatcgcgagcatgtggtcacccagtcggcgttgatcgagggcgcgctggaggccaagccgatgctggccatcgtcgccctgggcgatggtatggacaaccaactggtactcaacgccatgcgcgccggagcccgcgacttcgtggcctacggctcgcgttccagcgaagtggccggcctggtacggcgcctgagcaaacgcctgccccaggtcacgccgagcacccagctcggcggcctgaccgtgctctacggcacccagagcgatgccgatggcgccctgctcgccagccatctggcgctggtggtacagaagagcggccagcagacgctgttgctcgacctgggcctgccgcgcggcgacagcctggcgctgctggggctggaaagctcgttccacttcggcgatgccttgcgccatctgcggcgcctggatgcgaccctgatcgacagtgccgtcaccagcaccgaaggcgggctgcggatcctggcctatgtcagccatgacgagccgctggagcgcaccagcgccgccgagttgtacatgctgctcagcgccctgcgccagcacttccagcacatcgtggtgaacctcaccggacaaccggacagcgaagccctgcgcaccttcgtcggccattgcgacaagttgctctggtacaccgaccagagcgtgctcgactgccgccgcaacctggcggtgctcaatctctggcgcgaaaaaggcatgaagctggaacacgcccgcctgctggtcgaccgctacctgcgcggggtcgctccggatgcggaaaccctgggcaagacctttgccctggaagtgatcgcggtcctggcctatagccccgaggtacgcctcaacgcgaaaaaccagggcgtcacgctgttcgaactggccccccgcgaaggcctgacccaagccctgaagtccctcggcgagcgcctggccagacgctcccaagggctgcccacggcgaagcccggctggttcgagcgcctcaggggaagtcgatgagcagagaaaaacttttcggtgcccagtcccacagcccggtcggcaacaccgatcacgagggcctgaaactggtgctgcatcgctacgtcatcgacgccatcgaggaatcgggaaaaaacctgctggaaggttcgcgccaggcactggcgcgcttcattaccgacaaggtggccgagtacatctcgcgcctgcacctggcgatttcccgctatgaaatggagcgcctggccgaagaactggtggacgaactcaccggtttcggcccgctggaagtcttgctgcgcgatccggcggtgaccgagatcctggtcaacggcccgcaccgggtgttcgtcgagcgcgatggcgtgctgtaccagagcgacctgcgtttcatcgacgcgcaccatgtggagcgggtcatgcaacgcatcctcgcgcccctgggccgacgcctcgacgagtcctcgcccatggtcgatgcacggctgcccgacggcagccgggtcaacgcgatcatcccgccgatcgccctcgacggcccttgcctgtcgatccgcaaattccgcaaggacatgctcaagagcagcgacctgatggccatgcagaccatcgaccaggcgatcttcgaattcgtccaggaggccgtgggcaagcgttgcaacatcctgatcagcggcggcaccggcaccggcaagaccaccctgctgaatatcctcagccagttgatcaaccctcacgaacgcctggtgaccatcgaagacgtggccgaactgcaactgggccatccccatgtggtgcgcctggaaacccgtccgccgaacgccgaaggccatggcgaggtcaaggccagcgacctgatccgcaacgccctgcgcatgcgcccggaccggatcatcctcggcgagatccgtggcgtcgaagtgctcgatgtgctgacggcgatgaacaccggccacgacggttccatgagcaccgtgcacgccaacaatgcccaggatgccctgctgcgcctggaaaccctggtgggcctgaccgggcgccaggtggccgaacgcaccctgcgacagatgatctgcgcggccctggacgtggtgattcagctgacgcgcctgcccgatggccggcgctgcgtcagcgaggtggtggaagtggtcggcgtacgcgaaaacatctacgtcaccaacaccctgttccgtctgaaccgacgtagcggtttcggctttctgcgcgaagcggccaaccccgctggcgacaagctgcgacgcgacgccgacctgcccgtcaactgagcctgggagcgccaccgcatgttaggtcccgtgctgcttgccctcctgtgcctgaccctgctggggctgtcgggctggatgttctacagcggcctgcgccaggcccgtaccgcccgggtgctcgaccgcctggcccaggggcaaccgcaaccgagcgtggaaaagacctcgtggaaccggctcgaaagggcctttctgcgcgcgggcctcggtcgtcccaccgaacgcctggggctatggctggtggtctgggccctgggttgcatgctcgggtatgggctgggcaagtggccggggctgctcgccctgctcgtcgcaccgcctgtgctgctgcgcctgtacatcagctggctgtaccggaggcgcctcaagcgcatgatcgagcaactgccgcccttgctcgaccatgccgtgcgcagcctcaagtcggggcgcaccctggccgacgcggtgctgggtggcatcgaggccgccgacaatccgttgaaacacgccatgggccgggtccagcgcaacgtgctgctgggggtcaacctgccggatgcggtggcggacttcgccgaattgtacgagcgcgatgaactgcgcctgttcgccctggggctcaaggtcaaccaccgctatggcggcaatgccagcgagctgctggaaaacctgatcaagctgatccgcgagcgcgaccaggccgcccggcaactgcgcgcgatgaccggcgaaacccgcatcacggcgatggtcctcgcggccctgccggtgtcattggccggctatttcctgatagccaacccgacctacctgatgagcatgtggaaccagagcggcggccggatgatgctgctggccgccttcggcttgcaggtcaccggctgcgcgctgctgtggcgcatgctgcggagtgtttgacatgacagccttgctgatcagcgcactgttgtttctcgcagccatgctgctggtgctgggcaactggctggaacagcgccggcgaactcgccaggtcaccgagcgcctgcaggggcacctggcgcgcgataacacactcggcaactggctgcacgtgctgggcgacagcaaggtcggccagtacgcggtccggctcgacaatgaaacccagttgctgctcaaccgcctgggctggcgcagcgcgcggcaacgctcgctgttcgccgcctgccagatcggcgcaccgattctcgccctgggcctgaccctggtgatccaggcggtgtttttcccggcggcgaaaaaccactgggtcgctccggtgttcgccctgagcctcggctacctgttgcccaagcgcctgttggccatggccgccggcaggcggcagaaacaactggcggtcgatatctccaccttcattcccctggtgcgcatcctgttcgagtcgggcatggcggtggaacaggccctgcgggtgttgagcaaggacgcgcagaaattgctgccggccctgacccaggaactgcgcatggtgctggcccgggtggattccggcctggaactgggggacgaattgaacaagtccgcgcggctgctggccgtcgatgagttcaccgacacctgcgtgatccttcaacagctgatttaccagggcggtggggcgatgaagtcgttgcagtcgctcaagctgctgctcgatgaccggcgcctgacgcgcctgcaggaatacatctcgaagatgtccgcgaaaatgtccgtcgtgatgatgctgtttctcttcccggcgttactgatcgtcctggccggacctggcgtcagcgccattgcccgggccttcacccaccaatagaaggacgcaggggcccgcactgcacggcaaaagccggccggcatgcgcagcaaaccctcgctcgctactgctggggtttactgcgtggcgggaggcgtcagtgggcggtcacgcgctggcgcaaccccgagttgctcggtgccagcgccaacgccagttgggtgcggttgtgcatatgggtcaggcgcagcacctgggacacgtagagcttcacggtgttttccgtgatccccagttcacaggcgatctggtagttggtctgccccttgcctaccaggcgggccacatccagttgccggggcgacagctgattgaagatcgccgggacttcgatctgctccgcctcgccgccgccctggtccgacgcctgcgtcgtcggtggtgcgagtggcgcgcgacgtactttgtccagatcctggtaaaggtcgtcgatggattcggaaaggaactgcagcttctggttcaggtgccccagctgcaggtttttctgccgctcctgcaacgtttcctcctggcgttgcagaccggccagcagctcatcgaggtcgatcggtttctggtagtaatcggcgatgccggcgcgcaaggccttgatcacatcctgcttgtcggcctggccggtgagcatgatggcctcgaagacccgatgcttgccggcgatacgctgcagttcctgcaccaattggatgccatcgagatcgggcatgtgcaggtcgcacagtaccaggccgatttcggcatcttcattgaactgctggatcgcctggcggctggactcacaagggacgcagcgataaccgctgctttcaagaaactcgcaaagctcttcgactatcaacggctggtcgtcgaccacgagtactttgatgcgggatataagcttgttcacgcgcaactccatgcctggcaagcccaagacgaatgttcctgccctgccgcgtccacttcgggcaggtactaaataaacgtagactactttccgactatgtacatagagataggcggcatgaatagcgggcccaaatcagggtcagggccatgccgaccaggacgaaaggggcaaaggcgtacttttgcccctgccgcggatcgaggtactgcaaggaccttgccagcggttggtcggcagcgggcaacagcctgggcgcgagcaaccaccacaggccgctggccaacgcggcaccgatgaaggtacccagcaggtgcagggggtcggacgccagccccagggccgccagcagcttcacgtcgccgccgcccatccggcccagcacatagcccggcacggtcagcagcaacgccagcaacagcgccctgcccccctgcaccgcgtcggcgcccagccaggtgttgccggcccacagcaagtaccccagcgccagcagcgcgccccccagggtcaagccgttggcgagatgacgctggcggatatcctgcaccgcacacagccccagccaagccaatagaatccaatgctgcatcggttaaaaaacatcccttctggctgaatgattctatgctgacatgacctactagcagtcagggtagacgccgccgtgaaagccgacctgccagaaaaacaaaaaggtgccgtggccatcgagttcgccatggtcttcatcatttttttcgccgtgttttatgccctggtcagctacagcgtgccgcttctgatggtgcagtccttcaataaggccactgccgaagcggtgcggcgcagcgtcgccctggaccccgccacgcccggctatgacgccgccctgatagcgcgcgcgaagaacaccttgcgcgagcaactgacctggattccacaggccttcaacttcaatgccaacaacgccagcgatgccaccgtgacttacgcgggtggtctgctcacggtccgtgtccactactccaccgacaagctcagacaggtcatccccttcctggtgctgccgggcctgggcagcgtgcccgccctgcccgcgaacctcagcgcccagtcgagtctgcaattttgagctcgggcgacaaactcctcgggcgttttctcggccggacgacgccccaggcgcttcctcccgcgccgcccctggccacgcccggggtcggcctgctggtgcacctggaccacaacgcccaggtgctgcaaatgaccggcccgttgcgccacgccctggcccagccgccggccgccgaagggccggcgccgctgctggactacctgctggcgcacagcgcgctgagtgtcgaaggcagccctggcgactggcagggacatgtgctcgacctggacttccatggcgccggcgggcaaaccctgcacctgcgcggctgggtgcaaccgtccacccaaggctggctcctgcacctgctggatatcggcgacctgttgctggaacgccagcaggcgcagcaacgccaggactgccagcagttcgccgcgcagatcagcgaacagctgcgcctgtgcagcctctttcgcctgcccgaagtgttgcatgaacaactccatgccctggcccggcactggcatatcccctgcctcgccctggcactgctcgacgacctggaacagggctggtacatccacggcctgtatcaggcctccgatgcaccgcagctgtggcacaagggccaggtcctgggcaccgggctggacagcctgaacggcaatgccccgcagtcgctgatcttcactcaaggccttggcgagcatccgcgcctgcaacatgcgttcggcagcagcgaaggctttgtcgtgccctttcgcgacgatcacggtgtcgcggcctggctgctctgcggcctctacccggtacgccagcaggcaccgcagttgagcgaacgggactggctgcaattgagcgccgccctagccgggcccttgctcggacgtttgcgcgaacagcagcaccatcaccagctggagcgcctggaggccttgcaaggtttgctcggcaccggttggtgggagttgttcccgcaagacaacgagatccagctggcgccgcagctggccctcaacctgctgctggaaccccagacccggcgcctgtcgctgcaggcctggctggccctgatccaccccgccgatcgccaggaactgagcagccgcctgcaagagttgcgacagggcaaaccgctgctgctctgcgtacggttgcagcgagccgacccgcacctgccggccatctggtaccgcctgcaggggcaagccctgggcattggccagaaccagcgctttgtcggcttcatgctggacatcagcgacatcaagaaccaggagcagcaggccgccgcggcccacgcccggctggacaacctgatcgcccattcgccggcggtgatctatgtccaacgctatgtcgagggtgcgctgcagccgacgtttttcagcgacagcctgcagccgttgctcggctggaccctgaacgactgcaaggacggcgcactggcggaacgggtgcatgccgacgaccgcgaccgctacttcgagcgcaaccggcaactgctgcgcgaaggcgcggtgcgcagccgctaccgcctgctcgacagccgtggcgaataccactgggtgctcgacgaggccaggctgctgcgcgacgacctgggcatgccggtcgaagccgtcggcctgtggctggacgtcaccgacgccaccctggccgccgagcagattcgactcagcgaggagcgttaccggatcctggtggaagactccccggcgatgatctgccgctacctgcccgacctgaccctgaccttcggcaaccggcccctggcgacctacctggaatgcccgcccgaacagctggccggagccaacctcggcgactggctgtccgccgaacaacacgccgccttcgtgcagcgtatccgccagctgacccccgaatttccggtcagcaccgcggaaatcaacctgcaactgccggggcgcgaacatgcctggtgggtctggtccgaccgcggggtgttcgacgagcaaggacgcctgcgggagatccaggccgtcggccgcgacaacaccgaagtccgccgctcccagttgcaactcatgcaaagcgcgaagatggccaccctgggcgaaatggccaccgggctggcccatgaaatcaaccagccgctgaatgtgatgcgcatggccatcgtcaacgtgctcaagcgcctgaacaacggcgacgtgcaactcgactacctgcaggacaagctcaagcgcatcgatgcccaggtccagcgggccggccgggtggtggaccatatgcgggtgtttggccgcagctcggagatcgagcaacaacctttcgatccggcccaggcggtggaaggctgcctgtcgctgctggccgacggcatgcgcggcaaaggcgttgaattgcgtgtcgcgccaatcgacttcaaggtgcaggtgcggggccatgtcgatcagcttgagcaagtcttgatcaacctgctggtcaatgcccgggatgcgctactcggccggcgcgaacaggatccggacttgcggccctggatcgccatacgcgccgagcatgacgcgcagcgggtgcggctgctggtcgaagacaatgccggcggcatcgacccgcgcctgctggggcgcatcttcgaaccgttctttaccaccaagccggtcggcgtgggcaccggcctggggctctcggtgagctacggcatagtcgagaacatgggcggacgcctgagcgtgagcaataccggcgaaggcgcctgtttctgcatcgagctgccgctggtacagagcgatcagatcaccagataggcccggccggtttggccgcaggtgaggttggcgcccacctcgaccttgcccaggtcgatgcccaacaccgccaggacattgttcagcaatgggtccagcaacgggccgagcaaggcgccgatagccgtggccagcaggccgactacggtgttcaacgccgacagcaatgtattgagcaccaccccgagcaggctgccgatgctgggcggatgctcaatcagagtgatgccggtcaacgacgcgcgcaggctgctgaccacattggaagcggtcacgctgtgccaatcgtcgtccgccagttcctgcttcattttcggcggattgacgaaggtgaaattcggctcgtgggtgccggcgatccacgtgtcagcgcccggcacgtcgatcatcaactcgctgccgccgccggcaaaagggacacgcgccccgcaagggccaagcagcccctggcaggtcctcgcgccaatatccaccagcggcaatgggctcacgctgacctgagcggtcgaagacgcccagttgctggcgtccacccgaccgaccttgagcttgaccgcggaggtggtggtgtcgacggaaaggctgttgtcggtgtcgctgacgcaggtatagccggtgacatggctgtcgccggccgccacttcgaggctgacatccaggttcgcgccgttcggcagtatcagcaggtcggtctttacgcaggagccaccggagacacacctgagattgagaaccgtattgagcgtacccaccaacggttccagcagagcattcaccgcctgcagcacgctattgatcaacgagagatccaccgtcagcaacgcccgcacctgggcggtacgcacatagatgcgattgggtcccagcgggtcggcggcggccagttccgggttgccgatggcgaactcgggaggtgaaacgatcttgacccgggtggtgacgcccgccagccccaatacactcaccggcagctcgaccgccgcggcgctctggctgctggccagttgcaggaacgcctcgaccaggctcagcagctggacgttggcatccagcccggagtccgcggtgccggtctgcaacttcagcaggtcacccagtttcaccggaaccgtattgatggctgcggccttgatgctgcccagggccgtcaggacctcggcggtggcgccgttcttctgggccacgctgatgctggtctggagcagttgggtgatatcggtatcgacgtcgagcagttcgctgtagtttccggcgctcacattcaggtcgacggccagctgcttcaggtaaccgagcaggctgatgtcggtatcgaccaggccttgccaaccgagcaggctgacattgatcgcgctacccgcgaggccgctgagggcgccgttcaacaggttgagatcaaccagcgcgctgcgaatcgtcaattgcgccagcggtggcttgggttgggcggctaccgccgtggcgctcaacgaagtcatgtcgctgaggggcttgtcggaaaacagattggttacgctgagggcgatgctggtgggcaccgcttcactgaccaccacccggatggcgctggcctggctggcattggggctgaaggtgcgcaggttgtcggcaccggtctgcagcgagccgcaggtggctgtcagcagtctgtcgtctcctaccgcaaagccgttgcgcgccgcgctttctctggcgaatgccgccgcgctgagccccgcgtggcaattgccgccccgtgccaccgcctccaaggcggcgttatcggccactcgctgcaactcgcgctgatccaggtacaggcgcccgctgtcgaccaccaccagcgtgcacaacaccgccgtgctcagcgccagcgcccctatcagaccaatagcgccacgctgccgagccggtccggaaaactgcgtgcgggaaaacatggagcactcctttgccggcgcaccgccgggcgcaatctccgctgggtgaaaggagtgtagtcaaggctggaatacaacgctggcgacttgccagcgctgtgtttgggcagggtgccgtgtggggcaagggcccatgcagccctcgccccgtgatggaatgccgcgacttacctgggcgggtagttcgccaggatccggccgacggtctccctgatcgccgtgctgcgatcggcggggtttggcgtgctgctgagtatctgctcgtcgctgccgcgccacaccagcttgccgtccttgccatcgagcaggtcgatctggatggtggcgaccttgtaggtgatgttgcgggtttcgttgtacatcggcgcgccccagtagccgttccacgggccaccccagccgccgccgtaattggtggtgacctgttgctggcggttctcgacgatcaggtaggtctggacgctgagatcggccttgctgcccgccttggccggacgcaggccgcgctggtcaagctgatcgctgaccgcctggcggatgcgctgctcggtgaggtcgctcttgatccgtggatcgtcggggcggtattgcagggcgggttccttgaagctccagctgcgataggccgcgaagtcgcggctggcgtcgaagtcatggttgacctggttggcggcgcaggcgctgagcagcgcggccagggccagtaaagcaagagggcggaacatgatgtttctccagaagagcaaatgcacctgaagggatgtcgctagggtctgtacgaaaagtcggcgagcgaaggtcaggcaagcctgctttaacccagcccagcgtgcagcttcgtatggagcctaactaggaggatacgccgccatggccctttccacagcctcgcgcagcgcatcggcgcgctcgctcaggctgccctggctcgaggtttccgcgctggcgctccacaccggctggccactgcggccatcgaacaggttgacccgtaccaccacgacttccacctcgtaggtacgcaccaccggcactgtgttgtacatgccataaccagggccgtagcggttgtagccatatcctccgtaaccgtagccgtagtcgtcctgcacctggcgcaggcgcttttccaggtgcaggtcggcgctgacccacaggtccgccggacggttgtcatgcagcgggcgcaggccacgctggtcgagggcgttgctgaccgcctcggcgacctgcgctgaatcggcccaggccgagccattgggcaggcgcccgttgcgccaggcccagctgcgatagcgcccatagtcgcgctggggcgccggataggcgctgcggtcgaaggtgccggccgcctgcgggggcgccggcggcagtggattggaactggcgacataggggttggggctttggcaggccgccagccccaggcacagcacaagcaaaccagcgtggcgtttcatttcgagctccgctcagaccggacgacaaatccagtgcaggtaacgcccaagcccggcaaagcttgggtgacgacgatgggccaattccatttccaacagatccagcaactcggcgcgggcctggaattccaccggcatgtagtcatggaaaacccgtaccccgctctgggtttcgacccgccacaagccgtcgagttgcgccgccagttcccgcggatcgaggggctgttgcggggtcaggctctgcttctcgccggccatgtcgttcttgcgcatcttgcgaaagtggcccttgagcaggttgcgatagatcagcgcatcgcggttatagaaggccagcgacagccagccgtcctgggtggtcagttgatgcagcaccggcaggatcgcatggggctcggccagccattccagcaccgcatggcacagcaccaggtcatagggttcagtgagctggcccaacaggtcctgccagggcgcctggataaaggtcgcctgctggccggcctcggcgaaacgctggcgagcaccatcgagcatcggttcggccggttcggccagggtcacctgatggccacgctgggccagccacagcgacatatgccccagcccggcgccgatatccagtacccgcagcggccggtccggcaaggcttcggccaggtcggcctggagcaccgccaggcggatcgcgcccttggcgccgccgtagatcttttcggcgaaacgggtcgccagctggtcgaaatgacggtcgctcatcagccgaaccgccgttcactgtcggccagcttgctgcgcaccacctgctccaggtccaggcccagttcgctgcacagcagcaacaggtagagcacgatgtcaccgacttcctggccggcgtgggccagcttgtcggccggcagttgccgcgactggtcttcgctcagccactggaagatttccaccagctcggccatctccacactggcggccatggcgaggttcttcgggctgtgaaattgccgccagtcattgcggtcgcgaatggcgtgcaggcgttgggtcagttcgtctaggttcatcggggtctcctgaaggtgtatagcttcggggggatggcggatgaaggcaaggcccgcaccgccccctcaatcgataacgctgaactcgacccgcgccgtctgcccgccttcgtccagcacgctcagttgataaggccccaagcgttcgaagctggcgttgacgctgtcctggttggcactctcgcccagcggctcgccgttgacgaaccaccagcgccggccgctgccgcccagggccgacagcttgagccgcagcagttcctggctggccgccggacggcgcaagcgatcgccctcgcgcacgccgacgatggacaaaggcgcggctgccgccagggccggccccgggcactccgggtcgttggccggcaggcgcgcttcacgccgttcgatgcgcggcagccagggctccagcggcgccggccacagggcgatatcccgcgcctgcgcccccgggcacttggcgtcgacccgcaggcccttggcattgacccagactttttccagcaggccgacgcccaagggttgatccgccgcctgcaaggtcggcggcgtggtgccgtccagggtccaggcgaaacgctggcggcggcagttcggatcgctgcggctcatgggctggcccagcggccaacagatcgccgccaccccgacgttcatcggcaccggctgcaccggcgcgctgatgccacgctggctgtcgcggttgatcagcacatcgtgcacttgcagcatcaacggcgccgccgaagccaggccgaactgacccggcaccggggtgccgtccgggcggccgatccagatgccgatcaggtaacgcggcccgacgccaatcgcccaggcgtcgcgaaagccgtagctggtgccggtcttccaggccagcaccggacgctgcaccagctcagcccgcgggtcgcggtccgggcgcgcctggccgctgagaatgcgccgcacgatccacgccgaaccgggggacagcagcggccgctcgcgcaactcatcgtccggttgcaggcgcaggctcgcgctcttgccgccacgggcgaaggcgctgtagccgctgaccagatcctccaggcggctgccggcgccgccgagaatcagcgccaggttcggttccgccagcgccggcagggtcaggggcatgccgccgatgcgcatctcggcggaaaagcgtttcggcccgtaggcttccagcagttgcaccgccggcaggttcagcgaggtggccagggcagtgctggccgacaccgcgccgctgaagcccatggaaaagttgcccggccggtagtcgccatatcgccgtggcacgtcctgcagcagcgattcggaatggatcagcccggcatccagcgccatgccataaaggaagggcttgagggtcgaacccggcgaacgcatggcgctgatcatgtccacatggccgaagcgccgcgcgtcgttgatatccaccgagcccaggtaggcgcgcaccgccatggtctgcgcctcgaccaccaggatcgccgccgaggtgtgttccggcaggcgcgcgcgccagcccaaaagcaggtcttccaggcgccgttgcaggttggcgtccagggtggtgcggatcagcggcgggctgtccgggcggttcaaccggcgcgccagcaggggcgccaggctcggttccaggcgaggcgccaacaacagcggttcctgcaaggcttcgtcgaccgccgactgcggccagacctggaactgcgccaggcgctgcaacaccttgtcccgggccgtctgtgcccgtgcggcatgccggtccgggcgcagccggctcggcgcctggggcagcaccgccagcagcgccgcttcggcgtgggtcaggtgctgcggcgacttgcccaggtaagcccaactggccgcggccaccccttgcaaggtgccgccgaacggcgcgcggttgaggtagagcgtgaggatctgctgcttgctcaggtgccattccagctgcgcggtgcgccacagctggcgcagcttgccgtgccaggttcgcgagtgcggatcgagcaggcgcgccacctgcatcgacagggtgctgccgccggacaatacccgcccgcccgtgaggttctgccaggcggcacgcgccagcgccatcgggttgaccccgggatggctgtagaaccagcggtcttcgtaggtcagcagcgcgtccaggtaatagggcgagacgtcgtcggtgcgcaccggataacgccagacgccattgccatcggcgaagcgccacagcggcgtgccatcctcggccagcaccacccgcgccaggtcatccttgggcagcggcagcggccagatgcggtcggccagccagagcccggcccacagcagcaacaggccgcccagcacggcccgcaggatgcgccaacctcggcgaccgcttggttgcggcgatggcaagccgggcgactgtgccaggccaaatattcgccaccaaaaactgcgcaggcgcgatgcaactaatcgaaaaatcaaacccgcgaacctctatgcttggaacggaactcgccagcgcgattgatggccaaaggctcaggtctggcaagcacgccaactttttcatcaggatgcacgcatgcaggtagaaagcttttttgaatggctcggccaggcgctgggctcggtcatacggtttatcgtcgatggcctcagcggtctgttcaacgccctgaccaacgccggcggcaactttatcgacggcttgtcgcgggcgctgggcatggacacctcgatcatcagcatcatcaccctgatcgtcgggctgatgctgctgtactcggcggtccgcgccttcatgcgcgcctcgatcgtcatgggcatcatctggctgctgctggggttgtggctgctgagctgggtggtgcactgaccgatagacgaccgctgcgcggtcgtatcgcgagcaagctcgctcctacatgaggaacgcgcttgccgcgatcacccttctcaacgccccttgatcaccatctccggcagggtttcacccacggcctgccagttcggccggtacatcgactccacttgcggcggcggcacacggtaagtgccgggcgtgacggcgcgtgccaggtacagcaggtgcgtgacgctgtcgtagccgtccagattcagcgccgccacatagcggtcatcgcggaactcctggtgcttgaggctggcgttctgcatcgactcgcgccactccttgacctggctgctggcgttttccaggctggcggcgctctgcgccaggttctggttttccagttccaggccggccggcagcaggtccaccaccagcgcatccggcacccgttgcttggcgctgaccgccaggtgcaccagcatcaggtcgccgctgcccagggcccgcaggttcagtggctggccgttcatccccaggtattcgcgtcgaatgctcaggttctcgccaccggccagcggcgcctgctgtggataaccggaaatggtcagttgctggtacaccggctcgctgccctgattgctgatcgacaacggcgacgccagcaacgcgccttccagcttcaggccgggctggctgttgttcagctcgcggctttcggcgccactgctcagttgcgcggtccagttggcttccggcttgcccagcaggccgcgaccggcgaggaacagcgagttgcgctcctgggtcgacaggtacgggctggccgccagttggtcggacaactcgaacagccgctcctcgcgcttgcccttggccaggtcgttctcttccagcagcgccaggatcagcgcctgatcccgtagcgggctgccgtagtcggccagccagtccttgctgttgcgagaagccgcgaggcccgcggtcaaggcctgctcggcccgtggctgatcgcccattttctgcaaggcgatggccagctgtaccaatggcaggccggagcgcgcatcggtacgccattcgaacaggctgcgcagcgcgcccagcggcgcctgttgactgcgtgccaataccagcccggcgtaggcctgtacggcaaagcgcgtgtgctcggcgttttcgctgtagttgacctcgatcaggttgcgctcctgcaggtaacgcagcaggcgttcattggccttcttcagcgcctcggccggcaccgcgaagccctggtcgcgggcccgcagcaggaagtcggtgacgtaggcagtcagccagtattcctcttcgccgtccgcgccccacaggccgaagctgccgttgtagcgctgcatgcccagcaggcgttcgatgcccagctcgatcttgcgcttgcgctcggcatccggctcgccttccaggcccaggcgtttcaggctgacggcatcggcgtacagcgccgggtacaggccgctggtggtctgttccaggcagccgtaggggtaggccttgagcgcgcggatctgctcgccgaggttcagcggtggccggctcgacaggctcagcaatgcttcacgcccggccggctcgaacgccgccagctcgccctccggcaggctccatggctgatccttgagtaccgcgcggtaatgcctgagcaacgccgggtaagccggtcgcacccccagggtccattcgcggctgaacggtggcaggctctcgcccggaaggtccaggccattgaccagcaccttgaccttgccctggccgaagccgcccagcgcccgcaccggaatccgcaacgtggtgcgctggccctgggtcagttgcacgctctgacgggtttcgttgaccagcgccagctggccttcggcgctcagttgcacatcgagtttctgcgccttgcccgacaggttggacaggtccagcgccagggtggtctggtcgccgccagcgaggaaacgcggcgccgacagttcggcgatcagcggcgcggcgatcaccgtcttgccttcggccatgccgtagcgttcgtcggtccaggcctgggccatcaggcgcagttcgccgttgaagtcggggatgtcgacgctgacttcgccttcaccctgctcgttcagcgtcaccggcgcgctttgcagggcgacaatggtgacgctggtgtccggacgcttgccgcccttggccaacgccgcgtcgccaccgaaggccaggctggccagacggccctggccggcttcgatcagctggccgtagatatccagctggtcggcgccataggccttgcgcccgaacaggctggagtacgggtccggggtcgggtattcggtgatgttgaggatgcccacgtccaccgccgccagcagcacatgggcctgtttcggcacgctgccatcggcgttcctggcctggatcttcaccttgagcggctgtttggggcgcattttttccggcgccgtcagggtcaggccgagcttgcgctgggtgcgatccaggggcaggtgcaacacgcccaccgcgcgtttcggggtgatgttggccttgcgctcgccggggcggatcaccagcgcactgacgtacaggtcgtggcgcgcccatttcggatcgagcttgatcgcatagctcttgccttcggccgggacgtcgatttcctgccaccacaacggaccgtcgctggactccaccagcaggtagcccttgccggcggccggcggggtcaccgtgacattggcggtgtcgtcgtcgccatacagcggtttgtccagcgccagcttgacctggtcgggccgcaccgcgccgccttcggcgttgtcctgggaacgatagccggcccagaaacgcaggctgctgaccagcccggtctgcgggtcttcgacctcgacgcgataagggccccactccaccgggaagctgaccttcgcggtatcgccgtccttgatgctcaggacctgttcgtcctgggtgaggaatttctcgttgaagtgataactccagccgtcgctttccgagtagttccagtagtagtcgcggcgctcgcgcaccaggcgcaccttgaggttgtccgccgccagcttctggccttcattgttggccaccagcagctcgaactcggccgggccgtcgccgtcggtttccgcgccgtcgaacagcgcgcgcaaccccggcaacctgtccgccggccacaccggcagcaccacccgccgggtgatcgggcgaccgcccgactcctgcaggctgccctggacgatcagttgcagcggcgaacgggcctcggcccatttgctttccagggcgatcagttcttcgccgttttcatccagcgtcgactcctctatctccaggtcctggctcagctcttcttcggtgaccgagccgaactggtagcccggcaaggccttgaccgcctcgcgcagcggccgcacgtagatctggccgctcaggcgattgccggcggccggggcgccatacaggtaacggccattgacgctgatctcgacggtctcgtccggtttgagcggtgtgtcgctgcccttgagttccagcgccaggcgctcgggcaggaagtcttccacgaggaattcgtacagttgcggcttgccgtcgccgaggtcgaacaccagttgccagcgcccggtcggcgcttcgccggccagttgcaactggtactgatagagccccgaggcatcggcgtcccagacgaacttgcggctgacctgctcatccggccggcgcacttcgacgctcaccggctgcggcttgaccgcattgccgtccttgtcccgcagcagcgcattgagcagcacggtttcacccgggcgatacaggtcgcgggggccgaacacgaagaactgcaacggatggggctgggggccgccgatattgaattcggccaggtccagggcggcgccgttcaagcgcagcaggctggtctgctcgccctggtgggccagcagcacttcggctttcttcggcagcggcaactcggcatggccgcccttctcggtcttgccctggccgagcacgcggccttcgccgtccagcagctccaggctgacaccgtccagcgccttgccgccttccagggcctgggtgaagacatccaggcggttctggtaacggtgcaccgacagaccgatgtcgctgagggtgaacagggtcgccggttgcgaatagttgtaggtgcccgaggcacgcatcaccgccaggtacacgcccggctgttgcagcggcttgagcccggcgatcggcagcagcagggtttcccgggtattacgcgccgggttgaggtcgaagcggccgccatacaccaggtcggccatcggcagcagttcacgggactcgtaactgtgcaggctgttattgcgcccccattgggcgaggaacatcggcagcgattcgggcttgatgcggaagaactcgacatcgaccttgtcgacgttcagcgcgatcactggcaggccttcggcgaggcgggtcggcaacagggtgccgcggctggcgaacccgaccgtggcctgcaggtcacgggtttccaggcggctgacgtattcggcggccagggtcgcgtcgttcactgcgcgcagcccggcgtcgacggtcagcaccagtttgcgctgcggctccaggtggcgcaggcgcagttccatgaagttgtccgacagctcccaggcgccgtcgaccttgccgctcttgctgtccaccaggtgcagcttgtcggcgaacttctgctgcgggtccaggggcgccgagaaactcaccgacagggtgctggccccgtcgagctgcacctcggacacgtccaccacgttcaactcgcgaccggcgtagcgttgcttgagcacagcgacatcctgcacgggccgggccttggccgcgggcactgccgctgtcggagccgaagtgggcgccgccttgtcggaggtcgaggaatcgcaagcgctcagcaaggccagcgcacaggccaggaacaatcctttgttaaacatggggcactcattggcaggagtatcgaagggttgaactatatctcaccgccgtccggctggctgtggcgcagcgcacattgatcgactgaggccggcttcttggtaggattcgggccgtgatcgggatggcatggccgggcgggcaagcggctacaatgcccgctctcaaggagcctgcatgtccagcctgatttctgcctggcgccaccgtccgacccatgctcgggtgtgggcgctggccgcgccgatgattctttccaatatttccgtgccgctggtggcgctggtcgacagcaccgtcatcggccatttgccccacgcccatcagctcggcgcggtggcggtcggcgccagcctctataccttcctggcctgggccatgggctttctgcgcatgggcgccaccggctttgccgcccaggccgccgggcgcgccgacggtgcggcgctgcggcagatcctggtgcaaggcctgctgctggccatggggctggccctgctgctgggtgccataggcgtgccgctgagcggcgcggccttgcagctgatgcagccttcggccgagctggacgaaatgacccgcaccttcttccatacccgcttgctcgggctgccggcggcgctggccagcatggccctggtcggctggttcctcggcacccagaacgcccgcgcacccctggcgatcctgctgagcaccaacctgatcaacatcgccctcaacctgtggttcgtgctgggcctggactggggcgtggccggctcggccagagcctcggtgatcgccgaatggaccggcgcgctgatcggcctggccatgacccgcccggccctgcgcgcctatccggggcggattgcctgggcggcattgcagcgctgggccagctggcgaccgttgctggcggtcaaccgcgacatcttcatccgtagcctggcgctgcaatcggtgttcttcctgatcaccgtgcaaggcgcgcgcctgggggacgcgaccgtggccgccaacgcgctgctgctcaacggcctgctgctgaccgcccacgccctggacggcctggcccacgcggtggaagccctgtgcggccacgccatcggcgcccgcgatcgcctggcgctgcgccgttcgctggtggtggccggcggctggtcgctgctggccagcatcggttttgctgtgctgttcctgtgcgccgggcacctgttcatcgagatgcagaccgatatcgccgaagtgcgccagaccgccttcacctacctgccctacctcgccgccctgccgttgatcgcggtctggagctacctgctggacggcctgttcatcggcgccacccgcgcccgggaaatgcgcaacggcatgctgctcagcgtgctcatcaccctgccctgcgcctgggccttgcaggggctgggcaaccacgggctgtggctgaccttcctgctgttcatgctggtgcgcagcctgtccctgctggccttcgccctcgggctgcgccggcacgacggctggttcgctccagcccgctgagccttctggcgagcgtaaaaaaaaccaccgcaagcggtgggttttttttcgaacggtcaacctatcaggaagacaggtacgacgagcgggtcaggcccagacgcagggcgtcgaggaactgggtacgctcgctggcgctgatcttcgcgctggccaccttgtcacggtaatgagtcatcaactcctccggcgacaagtgcacgtaacgcagcatgtcttcgatggtgtcgtgggtctcgatcccggcgtggtacacggtgccgttcggattctggtagatgttcaccgagtcggtatcgccgaacaggttgtgcatgtcgccgaggatctcctggtaggcaccgaccaggaacacgcccagcagatagtcctcaccctctttcaggccatgcaccggcaggctggtctcgatgctctgctcgtcgacgtactggttgatcttgccgtcggagtcgcaggtcaggtcttgcagcacggcgcggcgcagcggctcttcgtccaggcgatgcaacgggatgatcggcaggacctggtcgatagcccaggtgtccggcaggctctggaacaccgagaagttgcagatgtacttgtcggccagcttgtcgttgagttcgtccagcacctggcggtgcgagcgctggcgcgccttcagcgagttgtgcaggcgccggcacacggcgaagtagcactgctcggccagggctttctcggccagggtcagcttgccgtcggcgtactgggcggccacgtcgctcatgtagtgggtggcgcgccagtaggtttcggtgaccatctcgatatcggtcgggcccagcaggtccaccagccattgcacggtttccggcaggctttccttgttctcgatcagcggcacgtcgtcgttgtgtttctcgacgtcggtcacctgcaccaccagcatggcgtggtgcgcggtcagcgaacggccgctttcggagaagatgtgcggatgcggcaggctctgcgcgtcgcagaactccttgagcatgccgaccacgacaccggcgtagtcatccatgtcgtagttgatcgaactggcgttgcgcgagtgggtaccgtcgtagtccacgcccaggccgccgccgacgtcgatgtgatccaccggcaggccgaggttgcgcagctcgccgtagtaacggatggcttccttgaagccgtgctggtagtccgccaggttggcgatctgcgagcccatgtggaagtgcagcaggcggatgccctggtccaggccggcgccgcggaaacgctcgaccaccgacagcagctgcgccgccgacaggccgaacttggatttctcgccaccggtgtcggcccacttgctcgacgccagggacgacaggcgcacgcgcaggccgacctgcggcttgaccttgagcgaggcggcctcttcgatcaccagggcgacctcggactccttctcgatcacgatgaacacgttgtggcccagcttctggcccatcagcgccaggcggatgaactcacggtccttgtaaccgttgcagacgatggtgccgcctttcggcgccagcgccagcactgccagcagctcgggcttggagccggcttccaggccgatggagacgttctgggtggcgatgatgttctcgatcaccgcttcctgctggttgaccttgatcgggtacagcgcggtgtacttgctctggtattccaggcgctcgatgttggcgtcgaaggcaccggtcagctggcgcacgcggtcctgcaggatatccgggaagcgcaccagcagcggcagggacaagccgctcttgcgcagctcctcgacttgttcgaacaggtcgatgggcgagctgttcgggccgttcggacgaacttcgacgcgaccggcgtcattgatcgcgaaatacccggccccccaatggcgaatcccataaacactgcggctgtccgcaactgtccattggctgccatcgtctttgcgtgtgcgtcgtacggacatcgaagtcccctataaagaagtcatagagcgccaccccggtccggggctggcgcagtctaaagaatgaaaatgacgattagcctgcaacgaggacgtagacctcggttacagcgctgagtttagaaaccggtcatgaacaggctctgtgaaaaccatgaagacgacggcaagcctgaatcggatcagggctgcatcaagtcaggggtggttttcacagaggctgctagccgccggacttcttcgccttgaaaccgtgcttgatcagctctgccaagagtagctcgacatgatcgccctggatctcgatgacgccgtctttcagcgcgccaccggtgccacaacgtttcttcaacgtggtcgccagttccttgagcgcgtcttcggccaacggcacgccggtgatggtggtcaccgtcttgccgccacggcccttgctttcgcgacgcacgcgagcgatgccgtcgccggcagggataacggtttgtttgcagatgcaggctgccaccggctggctacagtccgggcaatgtcgacctgcgtcggtggaaaataccaggccgccaagggcggcgaaggatgcggcttttttggccaccggcaatcctcttgggaggacaaagactggtcgaagcacatggcctgtgccatcgaccgcgaagccccactcaggcaggggcagcgctactggaccggtacatcttcgtaggagcgagcttgctcgcgaagaacacaaggataacgggggctatctgagagcatgcgttatcgttaacgtccatcgcgagcaagctcgctcctacaaaaagcagtgccggctcagcttgaaaaaggtcgcgcagtgtaacggcaaaaagccgacttgctaagagcctaaccgcgccaatttatacaactttagcgacgccgcgccagatagcgctgcaaggccgccagggagtccgggcaatagggcttttcggtgatttcccgcatcacttcgtcgatcgcaatgaagcgcgcttccagcacctcttccggctgcaggcgcagaggcccgtcccagaccgccgaaaaggccgagcaccagagacgattgtcggtgtcttcgaaaaagaaatggtcatgggcggtcaattccaccccgctcacgcccaattcttcctccagctcccgggccgccgactcggcgtagctttcgacggccagcaccatgccgcccgcggccacgtcccagtaaccgggataaatggccttgctcaaggtgcgccgatgcacgcacagctcgccggcggaattgaacagcaggatataggtgccgcgcccgatcaggccgcgctcgcgcaactccgagcgtgccagcgtgcccagcaactggtcttcgccatcgacccaggcgacttgttcggcatcggaggccgcgcgatgcgcggcctcattggaggtaaccaccatgaatcaaccctggttgagcaattgacgcaagtcgatgaccgccgcgttggcccgggaaatatagttggccatgaccagcgagtggttggccagcacgccgaagccgctgccgttgagaatcatcgggctccagaccggctcctgggacgcttccagctcacggatgatctggcgcacgctgacggtggcgttcttcttggccagcacgtcggcgaagtcgacctcgatggcgcgcagcaggtgcgacagggcccaggcctggccgcgcgcttcatagaacacgttgtcgatctgcatccaaggggtttccaccacctcttcgtcaacctgcggcgactggcccggcgccgggacttcggttttcagcgcggtgttgagcttgacccggccgacgctggccgacaggcgctgggacaacgaacccaggcgggtcccgacatcacccagccagttgttcaggttgtcggcacgggcatagaacaacgcgctcttctgctccggatcggacaggcgtgcctggtagcggctcagggaattgatgccttcctggtactcggactcgctggacggcagcacccagctcttgttgtcgaagttgaagcgcggctcggccttggccaggtcggcgtcctcggcggactgcgactgggaacgggcgaagtccttgcgcaaggcgcgggtcaggtcgcggacctgcaccagcacgccgtattcccagctcggcatgttgtccatccacaggcccggcgggaaacggtcgttggagatatagccacccggcttgttcagcagggtgccggccacggtcttgagggtttccaccgtggtgtagcccacgaccatctgtttgccttccttctcggcggccacctgcgcgctttgctggaccgggaacagcgacggttcctggctccagtaccagcccagggcaccggccaccagcaggtacaaggccaccagggtgcccagggcgcggctgaacagcaggccaccaaagtagctgcgtgtcgccgacttgggttcggcagcacgatccggcgcgctgcccgcgcggttcttccagtccagcatggctatatcctttcaatcacttgggttcatcggttcgaccacaaccttgctccatcgtgcctcgaaccgagcggattaaaaatcatccaccgcgcaaggcgccacatgccgggtgcatatcgagcggccactataaatgaagcacagttcagaacctatgcgaccagtcggtcgagaactgaataaggtcgctttgcagattgttgacgtacgacactcgtacaacccataagaggtgctagcatagagccaccagtcgatctcagcatgcaccctaactagtagtcaggatatgaccgagccagaagaccccagccgtgagcgcctcaagcaccactttgcccagcgggtcattcaccaggctcgtcagatcctcgagatatggcagcgcctgcagcgcagcgaatggtcgaccgccgacatgtccgaactcagcgaggccaacctgcgcctgctgcgtttcgccgaacgtttcgaacaacccgaacatacccagctggcacgcagcatcagcgactcgctggaagcggtggacgccaaccgcgggcgcctgagcagcggcctgatcaccgacctcaaccgcctgatgcaacgcctgtcgcgcaccggcttgcgccatggcgaccaactggaacagaccttcctgccgcccctgcgcaagccgatctacgtgatgctgcaagaccacgatcgcggcgagcgcctggccaagcagctggaattcttcggcctcagcgcccagtccctggacagcatcgccgcgtttcgcgcctcgatggtcgagcgcctgccggcggcgatcgtcatcgacgtcgacttctgcggcaacggcatgggcttgcaactggccgccgaagcccaggaaggcctggagcagaagctacccctgctgttcttcagcctccacgaaaccgacaccccgacccgcctggccgccgtgcgcgccggcggccaggagttcctcaccggcaccctggaagcctcgagcctgctggagaagatcgagatcctcacctgcgtcgcccagtacgaaccttataaagtgctgatcatcgacgactcccgcgcccaggccctgcacaccgaacgcctgctcaacagcgccgggatcatcacccggacgctgatcgagccgatccaggcgatggccgaactggccgacttccagccggacctgatcatcctcgacatgtacatgccggcctgtaccggcaccgagctggccaaggtgatccgccataacgaccgttatgtcagcgtgccgatcatctacctgtcggccgaagacgacctggacaagcagctggacgccatgagcgaaggcggcgacgacttcctgaccaagccgatcaagccgcgccacctgatcaccaccgtgcgcaaccgcgccgcccgcgcacgcaacctcaaggcgcgcatggtccgcgacagcctgaccgggctgtacaaccacacccatatcctgcaactgctcgaagactgcagcttccgcgcgcgccgcgaaaacaagccgctgagcttcgccatgctcgacatcgaccacttcaagcgggtcaacgacagccacggccaccccatgggcgaccgggtgatcaagagcctggcgctgtttctcaagcaacgcctgcgcaagaccgacttcatcggccgctacggcggcgaagagttcgccatcgtcatgcccgataccgacctggaagcggcctgcaaggtgctggatgaaatccgccagcgctttgccgaaatccattaccccgcccagccccaggacctgtggtgcaccttcagcgccggagtggtcgaactgcgggaagactccgacagcctgatgatggccagccaggccgacgaagcgctctaccgcgccaaggacagcgggcgcaaccgagtccaggcggcgcgccatcaaagcgccactttttcaccggaatccaccgattcggtcataaccttgtaatacaaacgcaataaattcaggcgcttaccattcaagtcgttggtaggacgcgatgcgcctgaagctgctgaccaatctcaataccctgctattagttgccgtttgcctggccctgggcgccacgctctggtggtcgcaacgcgccctcgagcgcccctacctattgatggagcgctacctggggttgtcccagcagttccagaaccaggtggcgcgcaacatcgaggactacctggccagcggcgacgccctgcgcctgagcagcgccagccaggccatcgaaaccctgcaagcccagctcgacgaactgcccgctgaactggcgcaaagcctgcacccgagcctgtcgggcctagccgagttcagcaagaccgacctgctggccgccggcaaactggccggcgatccgcaagcgctgctgctgcaggccgagcgcgagctgggggccagcctcgaacaactgagccaatacgcgaccggggcggccagcaatccgagcgccgcgccctacctgccgttgctgctgaccgcctcccagcacctgggcaagctgtccctggcccgcgacaaactggtgagcagcggccgcagcgaactggccgccgatgtcgagcgcgaagtgagcaacatgcgcgcccaggccgagcagctggaaaccctgccgttgctgggtgtcgccgccagcaacgcctcgaataccgatgacttcggggccatgatgggcctggagaacaccgagaaggccgccgccgaagacgccggcatcggcctcaagcgcgaactcaacagcctgctcggccgctaccccgccgagctgaaccgcacccgcgaacagatccagaaacgcgccgacctcagcgccgccacgcacctgaaaatcaccgccgtgcagcaggccatcgccgagctggaaccggtggtgcgcgcccagcacgggcagattcagggcgaagtgcggctgatgcagggcctgatgatcggcctgatcctgctgatcgccctgctgatcgacaccttgcagcgtcggctggcacgggtcctgaccaatctggcgccggccctgtcgacctgggccgaaggcgatttcagccgcgacatccagctgggccggaccaaccgcgaactgcacgacatcgaagcatccctgaaccgcctgcgcgcctatctggtggacctggtgggcaccatccggcagaacgccgaacaggtcgccggcagcagccgcgccctggcggaactgagcagtggcctgcacggcggggccgagcgccaggccggcgacaccgcgcagatccgcgacgccctcggcgagctggaagcgaccatccagcaagtcgccggcgatgccagccaggccgccgatgccagccgcagcgccggaatggcggtggagcaggggcagaaagtgatcggcctgagcctgaccgggttgcatgccctggtcggcgaagtgcaaggcaacgcgcagatgatcgaacagctggccgaggagtcggcgaccatcggcggcgtgctcacggtgatccgctccattgccgaccagaccaacctgctggccctgaacgccgccatcgaagccgcgcgggccggggaaatgggccgcggttttgccgtggtcgccgaagaagtacgctccctggcccaacgcacagcaggggccaccgccgagatccagaccctgatcgccggcctgcaggccgctgcccggcaatcggtggaaggcatgcgcgcccaggtcgaacatgccgaagccaccgccagccaggcccaggccgccgacggtgcgctggatgaaatcgtcggggcgatccagaccatttccgacaccgccatccgcatcgccgatgtcacggcccagcaaagcggcgccgtcagcgaaatccgcgaccacagcgagcgcattcatcagttgggtggggataacctgcaacgcatcggcgaaggccgcgaacaaggcgagaacctgctggccctcggcggccagctgcacacggcagtgcaggcgttccgcgtctagccctgtagccctgtagccctgtagccgctgccgagcctgcgaggctgcgatcgaggacgcagtcctcgcaaaaccagcctatgcaatttgtctgaaagaacgcggtcgcagactttacggccgctacgtcggaatgccgcccggaccgatcgcaggctcggcagcggccacggggcgcatacgcataccccgccgctctccgctatcatgcgcacaccttcgattcgcgagattgccatgcgtcgcctgctttgcctgatgctgtttgtgcttgccctgccggcgaacgccgccgggttgctggacagccgccccagttcgaccctgggttcgatcaacaacagcgccgacttcctgccggtgcgcgaagcgttccaactgagcctgctgcaaagcacgccgcagtcgatcaagctgcgtttcgtcgccaccgagggttattacctctatcgccaccgcttccagttccgcgccgagcccgccgacatccccctaggggccgcccaactgcccaagggcgaacagaaacacgatgagtttttcggcgacgtcgaggtctaccacggcattgtcgatgtcgaactgccgcgcagcgccacggaccaacgaggcttcaccctggccgtgacctaccagggctgcgccgacaagggcctgtgttatccaccggaaaccgagcgtttgcagatcgatggcgcggcctcttcggccaatgcctctagtgccggcggccccgctaccgacaatgggaaaaccgcctggagctggcgcgaactggcgctgttcttcctggccggcatcggcctgaccttcaccccctgcgtcctgccgatgctgccgatcctgtccggcgtggtcctcaagggccaggtcggcggctggcgcggcttcaatctgtcgctcgcctatgtgttgccgatggccgcctgtttcgccctgctcggcgccttgatggggctgttcggcgcccagctcaatttgcaggcacgcctgcaatcggcctgggtgctggtgccctttgcgttgttcttcgtcgtgttcgccctggcgatgttcgatgtcttcgaactcaagcttccgcgttttgtcagccagcgcctggaacgcattgccgggcgtaccgaaggtggctcgctatggggcgcggcgattctcggggtggtgtccagcctgctggtatcgccctgcgtttcggcgccgctggcgggcgccctgctgtatatcagcgccagcggcgacgccctgggcggcgccctgaaactgttcgccctgggcctgggcatgggcgcgccgctgttgctggtggccaccggcggcgcggcctggctgccgaaaagcgggccatggctggtctacgtgaaaaacgccattggcgtgctgttgctcggcctggcgatcggcctgctgagccgggtcttgccgggccaggtcagcctgttgctgattggcgcgctggcggccggtgtcggcctgtttctcggtgccctggagtttgtctacaaggcgccacgtgcgcgcctggcacagttgtgcgggctgttcctgctgttttatgccctggcctgctggtacggcgcgttcagcggccagaccgatccgtttagcccgctcgcccgcccaccggtcgcggccatcggcaacagccccgagcaaaccagcgccggccagtggcagaccgtcaccacccccggtgagctggagcaggccctggccgatgcccggaatgccggtaccccgctgctgctcgactggtacgccgactggtgcatcagttgcaaagtcatcgaacgcgaagtgctcaacgaccgccaggtcgtcgaacgcctgcggggctaccgcctggtgcgcttcgatatcaccgccagcaaccgcgaacagcgcgccctgctggaccgctaccaactgttcggcccgccggcgctgatgttcttcggcaaagatggcgtcgaacgtgccgatgtgcgtgtggtcggcgaaatcagcgccgcggacttcgctgaacgcattgctgcagcaaatgaccggatttagccagttggtcacatattttaggtaaacatcggtcatcgtgctgcctattgcagagaactggacagtcacaaaggctttgcggcatagtcgccgggttctgataaccgcacattccaatcactgcgcaataacaaggaacggcagatggcgaccctactggttcttcacggacccaacctgaacctgctcggcacccgtgaaccgggggtctatggtgcagtcaccctggctgagatcaaccaggacctggaacgccgggctcgcgaggccggccaccatttgctctacctgcaaagcaacgccgagtacgaattgatcgaccgcatccacgccgcccgcgatgaaggcgtggacttcattctgatcaatccagcagcttttacgcatacaagcgtcgcattacgtgacgcgctgctggcggtgagcatcccattcatcgaagtgcatttgtctaacgtgcacaaacgcgaacctttccgccatcactcctacttctccgacgttgcggtgggagtgatctgcggccttggcgccagcggttaccgactggccctggaggccgcactagagcagcttgaacaacaagctaaacgcccctgaccgacccttgggagttgatgattcatggatatccgtaaagttaagaaactgatcgaactgctggaagagtccggcatcgacgagctggagatcaaggaaggcgaagagtccgtacgcatcagccgtcacagcaagactccagcccagcagtactacgcaccggcaccgatggctgctccagttgccgcgcctgccgctgccgctccggccgccgctaccgcaccagcagcgccagctgccccagcgctgaacggcagcgttgcccgttcgccgatggtcggcaccttctaccgcaaatcctcgccaacctcgccagccttcgttgaagtcggccagagcgtgaagaaaggcgacaccctgtgcatcgtcgaagccatgaagatgatgaaccacatcgaagctgaaaccagcggtgtgatcgaatccatcctcgtcgaagacggccagccggttgagtacgaccaaccgctgttcaccatcgtttgaaccgcggagagccaacgatgtctgcgaagttggaaaaagttctgatcgccaaccgcggtgaaatcgccctgcggattctgcgtgcctgcaaagagatgggtatcaagaccgtcgccgtttactccaaggccgacaaggaactgatgcacctgggcctggcggacgaatccgtctgcatcggcccggcctccgccgcgcactcctacctgcacattccggcgatcatcgcggccgccgaagtgaccggcgccaccgccattcacccaggctacggcttccttgcggaaaacgccgacttcgccgagcaggtcgagaactccggcttcgccttcatcggcccgaaagccgagaccattcgcctgatgggcgacaaggtatcggccaagcacgccatgatcgctgccggcgtacctacggtgcccggttccgacggcccactgccggaagacgaagaaaccgcgttgcgcatcggccgtgaagtcggctacccggtgatcatcaaggccgctggcggcggcggtggtcgcggcatgcgcgtggtgcataaagaagaagacctgatctcctcggccaagctgacccgctccgaagcgggcgcggcgttcggcaacccgatggtctacctggagaagttcctgaccaacccacgtcacgtggaagtccaggtgctgtccgacggccagggcaacgcgatccacctgggcgaccgcgactgctccctgcagcgtcgtcaccagaaggtgcttgaagaagcgccggctccgggcatcgacgaaaccgcgcgccaggaagtcttcgcccgctgcgtcaaggcgtgcatcgacatcggctaccgcggcgccggcaccttcgagttcctgtacgagaacggccgcttctacttcatcgagatgaacactcgcgtgcaggtagagcacccggtatcggaaatggtcactggcgtcgacatcgtcaaggagatgctgagcatcgccgctggcaacaagctgtcgatctcccagaaggacgtggtcattcgtggccatgccctggaatgccggatcaacgccgaagacccgaaaaccttcatgccaagcccaggcacggtcaagcatttccatgctccgggcggcaatggcgtgcgcgtcgactcgcacctgtacagcggttacgcggttccaccgaactacgactcgttgatcggcaagctgatcacttacggggcaacccgtgaagaagccatggcgcgcatgcgcaatgcgctggacgaaatcgtggtcgacgggatcaagaccaacattccgctgcaccgcgacctgacccgtgacgaaggcttctgcaaagggggtgtgaacattcactacctggagcacaagctggccggtcaacactgatcgacaccgcaccagaccgacaaggccgctttcgagcggccttgtcgtttctgcccctcttgcaggagcgagcttgctcgcgatagggccatcagcgacagcgcgcattttcctggtgtcatgcggcgcccttgcaggcatcgcgagcaagctcgcgcctacagagaggcggtgcgggcaagtggaaatggcgcctggcgtgtcgtcttctgcgcctcgctcgcgtaaacttgcgcgcttctcgcagcccgctaggctgcacattacatatttcaaaggtgcccgccatgccttggctgcaagtccgtctcgccatcagcccagaacaagccgaaacctacgaagacgcttttctcgaagtcggcgccgtttcggtgaccttcatggacgccgaggatcaaccgatcttcgaaccggaactcaacaccaccccgctgtggaatcacactcacctgctggccctgttcgaagacggcaccgaggccgccagcgtgttggcccaccttgagctgctgaccggcagcccgctgcccgaacatcacagcgaagtgatcgaagaccaggactgggaacgcagctggatggacaacttccagccgatgcgtttcggccagcgcctgtggatcgtcccgagctggcacgccgctcccgagccggacgcggtcaacctgctgctcgatccgggtttggccttcggcaccggcacacacccgaccaccgccctgtgcctggaatggctcgacggtcaggacctgaaaggctgcaacgtgctggacttcggttgcggctccgggatcctggcgatcgccgccctgctgctgggcgccaaacaggcggtgggcaccgacatcgacgtgcaggccctggaagcctcccgcgacaacgccgggcgcaacaacatcgccgaagcgctgttcccgctctatctgccgcaagacctgccgcaggtccaggcggacgtgctggtcgccaacattctcgccggcccgctggttgccctggcgccgcagttgtccagcctggtcaagagcggcggacgcctggcgctgtcgggcatcctcgccgaacagggtgaagaagtcgctgccgcctacgcccaggacttcgatctggatccgatcgccaacctcgatggctgggtacgcatcaccggccgtcggcgctagaatggccgcctgtataaaccggatcgccgcatgaccgacagtttcgtcacccagtgtccgcattgccaaaccagcttccgcgtcagccacgcccagttgagcgtggcccggggcgtggtgcgctgcggctcgtgcctgcaggtgttcaacgccgcacggcagttgcttgagcaacgcgctggcaaggacgctgtcgtcgcatctcccgcaccggctgcccctgctgaaccgctggccccgccgccaccgcgcgccatcagccagaagcagtggagcgccaccgagctcgacctggacagcctcgacctggacgaggaactggccaaactcgaacagcgggaaatccagccgaccaaggccttcggccaggagcgcgcctccagggaagacgccctcagcgcccgccgcgaccagccggatgccgaagaggaacactggcccgacagcctcttcagccagccaccaggcaccagcggcgacctggacgaaaaacctgagcaaccgcccgtcgacgccggccgctccgggcgtaccgaaccgtcgctgtccttcaacctggacgatctggaagacgaacccaaggcgccctccctgctcctggacgacgacctggaacccatgccagcgcacggttccctgaagggcgacgagcccgatgaaatcgagccgccagtcagcccggcgccacgcaacaaacgtggccgcgccgagcccgaggcgccggacgccgtgttgctggacctggaagacgacccgatccagctggactggcaaaagcgccgttcgccctggggtcgccgcctgctctggagcctgttgatcctgctggccgccgccggcctggcgggccagtacatcgcctatcacttcgacgaactggcgcgccaggaccagtaccgcccctggttccagcagttttgcccggaactgggctgcacggtgccctcgaaggtcgatatcggccgcatcaagagcagcaacctggtggtgcgcagccatccggacttcagcggcgccctggtggtggatgcgatcatctacaaccgcgcgccgttctcccagcccttcccgctgctggaactgcgtttcgccgacctcaacggccatctgatcgccagtcgtcgcttcaagcccggcgaatacgtcaagggtgagctcgaaggggtgtcggagatgccgccgcagacaccgatccatatcgcgctggacatcctcgatccgggccccaaggccgtcaactacagcctgagcttccactcgcccgagtaaggcgcgccatccgagcaaagaccgctctggattgacggcggttttctgactgctgcccagcggaccaaaccgttggcaataacagaataactgttcagattttatccaattcagcctttatccagtcatcgagagcgggtatcatgccaaccctttttcgaactctcatgatccggccccacaacagggaagtcctatgtcggcggtacgcatcggcccatatacattgcacaacggcttgattctcgcccccatggcgggcgtcaccgaccagccctttcgtcagctttgcaagcggctgggtgcaggccttgtagtctcggaaatggtcaccagcgacatgagtttgtggaacagtcgcaaatcgcgtctgcgcatgatccacgagggcgatcccgagccgcgctcggtacagatcgccggtggcgatgcacagatgctggcggatgccgcccgcgccaacgtcgagttgggcgcacagattattgatatcaacatgggttgcccggcgaagaaggtctgcaacaaggccgccggctccgcgttactgaaagatgaagatctggtgaacgagatcctgcaggccgtggtggccgcagtcgatgtgccggtcaccctgaagatccgtaccggctgggaccgggcgaacaagaacggcctgacggtggcgaagatcgccgaacaggcaggcatcacggcattggcgatccatggccggacccgggccgacctgtacacgggcgttgccgagtacgacaccatcgctgcgatcaagcaggcggtgtcgatcccggtcttcgccaacggcgatatcgactcgcccgagaaggcccgctacgtcctcgacgctaccggtgccgacgggctgttgattggccgggccgctcaggggcggccatggatttttcgtgagatcgaacattttctgcgtaccggtcaaaccctgccggcacctgagctgttcgaggtggaacgtattctgcttgagcatctggccgcgctgcatgccttctatggcgatgtcatgggcgtacgcattgctcgcaagcatgtgggctggtatctcgcaactctgccgggtgccagggagtttcgtgcccacttcaatcgtttggaagatacggaagcacagtgcgccaacgttcgtgagttctttgccgagcgttacaagagcctggtgacaggggacggagaaggggtggccgcatgacgatgatgaccgagactttagtgagtggaacagcacccgtgagcgacaacgtgaatttgaaacagcacctcaatacgccgagcgaagaaggccagacccttcgcgggagtgtcgagaaggcgctgcacaattatttcgcccaccttgagggcgcggccgtcacggacgtgtacaacctggtgctctccgaagtcgaggctcctttgctcgaaagcgtgatgaactacgtcaagggcaaccagaccaaagccagcgagctgctcggtctgaaccgcggtaccctgcgcaagaaactcaagcagtacgatttgctgtaagcattcaatcaaaccagaaaggcgcccgcgtaaaaccggtcgccttttttgctgactcctttgcttttgatggaaattgagatgaccgaccagactacccgcctgccgatccgccgcgccttgatcagtgtttccgacaagaccgggatcctcgaattcgccaaggagctggaagccctgggcgtggagatcctctccaccggcgggaccttcaaactgctgcaggacaacggcgtggccgcagtggaagtcgcggattacaccggtttcgcggaaatgatggacggccgggtaaagaccctacatccgaaaatccacggcggtatcctcggtcgtcgcggtatcgacgacgccatcatgaacgagcacggcatcaagccgatcgacctggtagcggtcaacctctacccgttcgaagccaccatctccaagccgggctgcgacctgccgaccgccatcgagaacatcgacatcggcggcccgaccatggtccgctcggcggccaagaaccacaaagatgtggccatcgtggtcaacgccagcgactacggccaggtgctggaaagcctcaaggccggcggcctgacctacgcccagcgtttcgacctgatgctcaaggccttcgaacacaccgcggcctatgacggcatgatcgccaactacatgggcaccgtgaaccaggcggccgaaaccctgaccaccgaaggccgcagcgaattcccgcgcaccttcaacagccagttcatcaaggcccaggaaatgcgctacggcgagaacccgcaccagagcgcggcgttctacgtggaagccaagcctgccgaagtcggcatcgccaccgccacccagctgcaaggcaaggaactgtcgtacaacaacgtggccgacaccgacgccgcgctggaatgcgtgaagagcttcgtcaagccggcctgcgtgatcgtcaagcacgccaacccgtgcggcgtggccgtgagcccggacgccgaaggcggtatccgccaggcctacgaactggcctacgccaccgacaccgaatcggccttcggcggcatcatcgccttcaaccgcgaactggacgccgagaccgccaaggccatcgtcgagcgtcagttcgttgaagtgatcattgccccgagcgtcagcgaggaagctcgcgccgtggtggcagccaaagccaacgtgcgcctgctggcctgcggcgagtggtcggcggaccgcgttccggcctgggactacaagcgcgtcaacggtggcctgctggtgcagagccgcgatatcggcatgatcggcgccgacgacctgaaagtggtgacccagcgcgcgccgaccgaacaggaaatccacgacctgatcttcgcctggaaagtggccaagttcgtcaaatccaacgccatcgtctacgccaagaaccgtcagaccatcggcgtcggcgccggccagatgagccgcgtgaactccgcccgtatcgccgcgatcaaggctgaacacgccggcctgcaagtgcagggcgcggtcatggcgtccgatgcattcttcccgttccgcgacggcatcgacaacgcggccaaggtcggcatcaccgcggtgatccagccaggcggctcgatgcgcgacaacgaagtgatcgccgccgccgacgaagccggaatcgcaatggtattcaccggtatgcgccacttccgccactaagtatcaatggggcgccaccctctcctgtagccgctgccgaaggctgcgataagacccgaagggtcttcagcgatctgaaatcctgcaaccgcttcgcggttgatcgcagcctggcggcagcggctacaacgtcaggcttgtgcgcttcaccgaatttgcgtcatccgaggtttttgaaatgaatgtactgatcattggtagcggcggtcgtgaacacgccctggcctggaaagtcgctcaagacccacgggtcgagaaagtcttcgttgccccgggcaacgccggcaccgccatcgaagccaagtgcgagaacgtggccatcgacgtattggccctcgagcagctggccgactttgccgagaagaacgtgtccctgaccatcgtcggtccggaagtaccgctggtggctggcgtggtcgacctgttctgctcccgtggcctggactgcttcggtccgaccgctggcgcggcccagctggaaggatcgaaagccttcaccaaggatttcctggctcgccacaagatcccgaccgccgactaccagaacttcaccgagatcgagccggccctggcttatctgcgggaaaagggcgcgccgatcgtgatcaaggccgacggcctggccgccggtaaaggcgtgatcgtcgccatgaccctgagcgaggccgaagacgccgtgcgcgacatgctggccggcaatgccttcggcgacgccggttcgcgcgtggtgatcgaagagttcctcgacggcgaggaagccagcttcatcgtcatggtcgacggcaagaacgtgctgcccatggccaccagccaggaccacaaacgcgtcggcgacggcgacagcggcccgaacaccggcggcatgggggcctactcccctgccccggtggtcaccgccgacgtgcaccagcgcgtgatggaccaagtgatctggccgaccgtgcgcggcatggccgacgaaggcaacgtctacaccggtttcctgtacgccggtctgatgatcgacaaggccggcaacccgaaagtcatcgagttcaactgccgcttcggcgatccggaaacccaaccggtgatgctgcgcctgcaatcgagcctggtgctgctggtcgaggccgccctggcccaggcgctggacaaggtcgaagcgcaatgggatccacgtccgagcctgggcatcgtcctggccgccggcggctatcctggtgactacgccaaaggcgcggtgatcgaaggcctggacgcggccgccaaactggaaggcaaagtcttccacgccggcaccgcgctcaaggacggtcaagtggtaacctccggcggtcgcgtgctctgcgccaccgccctgggcgacagcgtaagtgccgcgcagcagcaggcttaccaactggcagctaagatcgattggcaaggctgcttctaccgcaaagacatcggttaccgggccattgcccgcgagcgtggcgaaagtcaggagtaatcctgtcttcctgtccggcaggggccccaggcccttgccggacggctccagcgccgcgcatagttataatctggcatcaacctacgaagggatttcgccgtgcgctggctcaggactgccataagtttcaccgtcactctgctgaccctgctctgcttgatcccggcccaggccgcacaaggcagtaactgggccgttttgctcgatgaacaggccgacctgcaactgagcgatatccgctccccgcgctacaccaatcaattcagcccgatcgaactggaacgcatcaccgccgccgaacccggaggcgcgttatggctgcgtttcaaactgcaaccgggcaagcacgaacaactgctgcggatcttcgcgcccgacctgtcacgcctggacatgtatgtactggatggcgacaacctggtcgagcaactgacctccggcacccagcagccccaggccgaacggcctttgcccagcagcgacttcatgctgccgctgccgcagaaccagaagaccctcgatgtctatctgcgcctggtctccgaccatcagctgcgcccttacatcaccctgcaaccagcggtcatgaccgcggccaatcaaggccagagcgtgctgtacggcctgctgttcggctgcatgggcatgctgatgctgcacaacctggtgcgctacgcctacacccgttcgcgcagcagcctgtggctggcgtcctgcgaagccctggtgatgctcagcctggcgctgatgctcaacctgttcggcccctggctgccggactggcacgcgatacagacccctggcgcctacctggcgctgttgctgaccaccccttgcgggctgatgttcgtctatcgcttttttgccccgctgggcccgcacccgctgaacaagctgctgctggtcgacatgctgatggtcggcctgtgcagcctgttgctgttgttcgtcgattcgctcccgctgaacctcatcacctacggcctggtggccctggtcggcctgagcatgctgttcatcgccggttatcactggcacaaaggctaccgcccggcgcgctacttcgtggccggcatgggcatcttcaacatcggcgcgctgatcgtgctgccggcgctgctggggctgaccatggtcgcgccccagggcctgatcgtcaccctgctggtgatcatgtgcctgagcgggtgggcgatgagcatcgccctgggcgagcgccagcgcagcatcaccgagaacgagttcagcgtcagccgtgacctcgctgccagcaacgccgaggtcaatgccaaggccgagttcctggccaagatcagccacgagatccgcacaccgatgaacggcgtgctgggcatgaccgagctgctgctgggcacgccactgtcggtcaagcaacgcgactacgtgcagaccatccacagtgccggcaacgagctgctgaccctgatcaacgagatcctcgacatttccaagctcgagtccgggcagatcgagctggacgacgtgcagttcgacctcaatgcactgatcgaggactgcctgagtattttccgcgccaaggccgagcagcagaacgtcgagctgatcagcttcatccagccgcaggtgccgcgcgtgatcagcggcgacccgacgcgcttgcgccaggccatgctcagcctgttggaaaacgccctgaagaagaccgacgaaggcgaggtcctggtggtggtcgcgctggacgagcgcaccagcaaaccgcgcctgcgcatcgccgtgcaggacagcggccagccaatggaagccgaagagcgcgatgccctgctgcattcggaactgcacagcaagaacttcctcgccagcacccgcctgggcggcaatctcggcctggtcatcgcccgccagctgatcctgctgatgcatggcgagttcggggtcaagaccagcgccaaccagggcagcaccctgtggctgaccctgccgctggaccctgagcgcctggagcacccgacgtccgacctggatggcccgctgcaaggcgcccgggtactggtggtggacgataacgacacctgccgcaaggtcctggtgcagcaatgcagcgcctggggcctgaacgtcagcgccgtgccttcgggcaaggaagccctggccctgctgcgcaccaaggcgcacctgcgcgactacttcgatgtggtgctgctcgaccagaacatgcccggcatgaccggcatgcaactggcagccaagatcaaggaagacccgagcctgaaccacgacatcctgctgatcatgctcaccggcatcagcaacgcgccgagcaaggtcatcgcgcgcaacgccggggtcaagcgcatcctcgccaaacccgtggccggctacaccctcaagaccaccctggccgacgagctgacccagcgcaacaagggccaactggtcccccatcagccccattcgctgagcggggttccagtgccggtcaaggtaccgagcgacttccgcatcctggtggccgaggacaacagcatctccaccaaggtgattcgcggcatgctcggcaagctcaatctgcagcccgataccgcgagcaacggcgaagaagccttgcaagcgatgaaggcccagcgctacgacctggtgctgatggactgcgaaatgccgatcctcgacggtttctccgccacccagcagctgcgggcctgggaagtcggcaaccagcgcgtgcgcacgccggtggtggcgctgaccgcgcacatcctcaccgagcacaaggaacgcgcgcggcaggccggcatggacgggcacatggccaagccggtggagctgtcgcaactgcgcgaactgatcgaacactgggtggcgcagcgcgatcagcagaaccgcaccacggcgcaaccgtcctgagccgacagtccggcaaacgcctgttaaactccgctcgccctccctcgctgtgagtttgcgccatgctccatgtgctgttcagcgtgtacctgaagatgctggtgctctatagccccttcttcgtcctgtcctgcttcatcagcctgactcgcggctactccagcaaggagcgtcggcgcctggcgtggaacgtcgccctggcgaccctggcctccagcgtgctgctgtatctgttcggacgggtgatcttcaatgtgttcggcatcaccgtggacgccttccgcatcggcgccggtagcgtgctgttcatctcggcgctgggcatggcccagggcaagtcggcgatccagaccgacaacgtgcagcaggacgtgaccatagtgcccttgaccatccccctgaccgtcggccccggcaccatcggcgccctgctggtgatgggcgtcagccagccgcactgggacgacaaactcaccgcgatcctcagcatcgccctggccagcttcacggtcggcgtggtgctctacctgtccaaccgcatcgaacgcatcctgggcgagcaaggcttgcagatcgtcagccgactgatgggcctgttcgtctgcgccctggcggcgcagatcatctttaccggggtcaaggggtatctggggtagaggcagctgcaagctacaagcggcaagaacaagcaggctcactggggacagtgagcctgggctttttccggggtgggagttttttacgcctgcagttgccactgcaaggcatccagcgcgtcgcagccgtcttgcagcaacaggtgggcggcgttgacgaagtgaatcagatcctgatcgcccacacctttgacactcaggcaattgaggctatgcatcaaatcccgcgaagccttgatgcgctgtaccgcgccgccatgcagatcggctgcgggcgcgttgcggtcgaggtggaaaattggggtgggagtgagattgctttgtagggggatgaagtccgtcatggtcatagctccttagttgcataaagagctgccactctttgcggctaaacaaatgggaggcagctgtgcgagggttagccgaccagggatggagctatgaacattccccggcacacccaaaggtgtcccgcgcacagccaccataaaggatgccgcgcaaccaaaagcgccagcatggtaatggatggcgcttaagcgttcatagccccacatttcgaccggctaagatcgaccgccgatgcgtcggcgaccgggcaactatggcttcgcaaaaaaccagcgacaaccctcaatgtgttgccattctttccctctgacggcccccacgcttcctgtagccgctgccgagcccgcgaggctgcgataggaccgaaggtcctccagcggtttcaagaccctgcgtccgcttcgcggccgatcgcagcctcgcaagctcggcagcggctacaaggtttagcgccgaccggtaggtcgcgcccggcttttgatcttgatctacccgccccatcgggaggccgagtggaggtgttcatcaggggaatggcgcgcagcgcccctcgacgcagtcgaggacatcgtatggaggtcgaagcgaagccgaccggagtcgatgccccctgatggacgccggagcgagggaacctgagcgcagcgaaggccgtacgcaggggcaagcgttttttggttattttttttggcgtttgaaaaaaagtgacccgccgtaagggcggaaccctaagtggccgttaccgcagaaacggatatgtaccccgtccaaaaaatgcagcgccagaacggacgccatcgcaggcaagcctcgcccctacagcggttcgaagttgcctaaggtttctgcccgtaccacctcggcgtatacacccactccccacctccagccttgggaaacacacaggtcgtggatgaccccaccaacaccatggtgcgcatatccacctgctccggtgtcagggcacccagggtggtgacccgcaaagtctgccccggacgcccgatatcccgccccagcaccaccggcgtatccgcagtgcggtgctggcgcacgatctccagcgcgcgccccagttgccaagggcgcgagcgcgagatcgggttgtagaacgccaaggccaggtcggcctgggacgccaggtccaggcgcttctcgatgatggcccagggcttgaggttgtccgacagcgacagcacgcagaagtcgtggcccaggggcgcaccagcctgggccgcggtggccagggaagcggaaaccccgggaaggatttccagctcgacctgatgccagctcggctcgctggattcatgcagcgcttccagcaccgccgcggccatggcgaagacccccggatcgccggaggacaccaccaccaccgaacggccttgggccgcgagctcgaaggcgtggcgggcacgctgcatttcttcgcggttgtcggtgcagtgcatgacctggtcggcacggaacgggccggccatgcgcacataggtttcgtagccaaggatatcgttggcccgcgccagttcggccttcaccgccggcaccatcagctcggcagcgccagggcccaggccgatcaccgccaggcggccacgggagcgaccgatctgctgcgggtccagcggctggctggccacggcaatggcgatgtcttcacccacgctgagcgggggcaacagttgcggtacggcctgttgcgccaactcggcgacgctgcccgccgccggggcgaaacgcaaaggtacgcccagctcggcggcggcttcgcgcaaggccgggctggccatctcggtatcggcggccagcaggcaagcgacggactgcacggcgattttggcggtgtgcagggcggctcgcagatgcgcggcgagttcggggccgctatcgcgagcaagctcgctcctacaggtgagggcgatgaggacgctgcgcggatagatcagcagttcgttggcggcgggctcgcgctcggccgagccgacgcggatggtcagccgggcgtgccggtcttccggcaaccgggcctcggccagccagggcgcggcgccttcgatgcgcacgctttcaccgcccagcagatcggagacgaaacgcttgcccagttccagatcacccagggcataaccgctgggcgggttgagcaggcaggtgccgaagcgcagctcgccgctggtggtgatggccgccgccacgcccaggccggcggcaatttctcgggccatgacgttcactccgcccaggccaccgagcaacggcaccacggcgctgccgtcttcggccacggccagcaccggcggctccgcgcccttctccagcagcagcggcgccagggtgcggatgacgatgcccgcggcgcacagggcgatgatcggcgtgtcctgttgatacagctggcgcagggtcgcgccaaactcctggtacgggcggtcggcgccctcgacccgttcggccaggccgtggatcagcgcgtccgggtacagctgctgaagtttgcgtgcagtcgccaggctgccttggccaaggatgacgatggccggtgcggaatgggccatcaaccttgccacctttcaccgggcacgatgatcaacgagaaatacggcgacgacatcggctgcacttcatccagcggcacgatcttctggttggccatggtcgcgcgctcgacgtacagcgcgcgctcggccaggcccagctcttcgagcacctggcgcaccttggggaagttgcgccccagcttcatcaccaccgccgcgtcggcatcggccaggcggcgcttgagttcgtcatggggcaacacgccggagagcaccgacaggctctggttgcgatacaccagcggcgcgcccagcaccgaggcgccaccgagcatcgagcacacccccggcaccacttcggccgggtaacgctcggccaggcggtcgtgcaggtacatgtaggaaccgtagaagaacgggtcgccttcacagatcaccgccacatcgcggccggcgtccaggtgcctggccaagtcttcggcggcgctgtcgtagaagtcgctgatcacttgctcgtaagacagcggcgctggcagcacttcggtggtcaccgggtagaccagcggcaacagggtctgcgcgccttgcaggtgcgcttcgatgatgccgaaggcattgccctttttacccttggcgacgaagtacgccaccaccggcgattcgcgcagcaggcgcagggccttgacggtaatcagttccggatcaccggggccgacgcccaggccgatcaaacgtccaggttgctgcatcattcgatctccgtggccagggcgttgacggcggcggcggccatggcgctgccgcccaggcggccttgcatgatcacgaaaggcacgccgcggctgtcggcggcgagcatcgccttggactcggccgcgccgacgaagcctaccgggaagccgaggatcagcgccggtttcggcgcgccggcgtcgagcatttccagcaggtagaacagcgcggtcggggcattgccgatcaccaccacgctgccttccaggtacggccgccacagttccagggccaccgccgagcgggtgttgcccagctcgcgggccagctccggcacgctttcgtcgcgcagggtgcagatcacctgattgttcgccggcagacgggcgcgggtaatgccttcggccaccatgcgcgcatcgcagagaatcggcgcgccggccgccagggccgcacgcccggcctggcccgcgccttcggagaactgcaggccgtcgatggcatcgaccatgccgcaggcatggatcacccgcaccgcgagcttttccaggtccgcggggatgcgatcgagcctggcctcctcgcgaatgatcgcgaaggagttgcgatagatctcctgaccgtcgcggatgtaatcaatcatgggtgttgctccgtgggcgggcatcgagcaatgcgccggccgcttcaagggaaaggttgcgtgcgtgcagcgtgccgaaacccggctgcgcggcatcgcgaaaatagaggtcgtaacgaccgggggcgacggccagcaaggtagccggtgccacatgggcggcggcgcaggaacgcgagcagccggacaggtgcacgtccagcggatggccgtggcgctggagcaaggcggccagcttcagcgcgtcgcccttggtgtcggccagggccttgccgcagccgctggaaccggtgcaggcaatcaggtgggccaggggctgctgcggcgaacagagaaaccccagctgttgcaggcagcgcgtgatttcaggcgcgtcttcggcccgcaggttcggcagcaacaggctctgccagggggtgaacctcaggctgccatcgccccattgctcggccagctgagccgcgccgcgcagcatcgacggggccagccgccccaggggcgtgacggcaccgacatagacctggcccggttgccgctgtggataagtgccgatatacagcggctcggaagggggctcgcgctgccaatcgcccaccctgatcaccggcccgggcaagcgcgcggacacctgcgccagcagctcgtccgccgagtgctccgccaacagctggcgcatgcggatctgttcggggcgggccagatcgaggaacagctccagcaccgccaccaccagggccagcccatcctccagcgccacgctggccaggggccgatccccagggcagccggccaggccgaaggccagccagggctcgcccgcgccttcgaacgccgaaagccacaggtcatggggatgttccagcatggccagggcttcgccaccgtcgagttgtacggcgaacttgggcgacaactcatgaaagcgcggatggctttgcacagtggcgagaatctgcccggccaggggacgggtgtcgacgatcatcgtgcggtcgatcccggccgtggggctgagcatcaggttacgcacgtcatcgccggccgcgctggtcggccccagaccggcggccagcagctcggcaatcagcgcctgatgttcggcgccgatcccgcgaatctgcaggttggcgcggttggtcgcctcgatcaccccgccggcataccgctcggccgcagcggccaccgcgcgggcctgggcggcgctgatcgccccgccggccagcttgatccggcagataccgccgtccagtgccgggacgatacgcagcaaccccggacaggccgaggggcgtaaggcggtggacatcgggcgttcgttcaagggggtgaccggctgtgtgggaaaggcgcttcgcgggcgaaggcgcggtattatgcctgctttgtccgaaggcatgaaaagcctgcctgtcggaagaacaggttttaccctcgaggaatagcgatgtcgccctggctgacagtagtgggaatcggtgaagacggcttcaagggcctgggcaagaatgcccggcgggccctgctgggcgcttcgcggatcgtcggcggccagcggcaactggacctgttgccggtgtgcatccgcggcgagcggcaactgtggccgagccctttctcactggagccggtgctggccaagcgcggcgagccggtgtgcgtgctggccagcggtgacccgatgctgttcggcgtcggcgccagcctggcgcggcaggtggcccaggaagaaatgcacgtcctgcccgcgccttcctcttattcactggcggccgcgcgcctgggctggccgctgcaagaggtggtgacgctctcggtggtcgcccgccccgtggccgccctcagcgcccagctgttcagcggcgtgcgcctgctggtcctgagcaatgacggcctcagcccctcggccatcgccgcgctgctgcgcgaacgcggcttcggcccgagccggctcagcgtgctcgagcacctgggcggcgaggccgagcgacggaccgaaggcaccgccaacgactggagcgacccggccatcgccgacctcaacttggtggctatcgaatgcctggccgagcccgatacgccgcgcctgtcgcgcctggccggcttgcccgactcggccttccagcatgacggccagctgaccaagcgcgacgtccgcgccattaccctggcccgcctggccccggtgcccggcgaactgttgtgggatgtcggcgccggcagcggctcgatcggcatcgagtggatgcgcgcgcaccccagctgccgggccctggccatcgaagccgacccaggccgccagcaactgatcgaacacaaccgcgatgccctcggcgtgcccggcctgcaactggttcgcggcagcgcgccccaggcgctggatggcctggaagccccggacgcgatcttcatcggcggcggcgtgacccgccccggcgtactcgacgcctgctgggcccggctcaagcccggtggccggctggtggccaacgccgtgaccctgcaaagcgaaacgaccctgatggcctggcgcgaacgacatggcggcgagctgacccgcatccatgtcgcccaggccttgccgctgggggacttcgacacctggcgccaggccctgcccattaccttgctcgacctcgtcaaaccgctatgagcaccctgccctcccctgtaggagcgagcttgctcgcgatccagaccacacggtccgtctggcgaacgctatcgcgagcaagctcgctcctacacaaggccataaagcatgcgtgaagaaacggcggaacaacccgccccgctgcgcagcggcctgaccactggcagctgcgccaccgccaccagcctggcggcggcgcgcctgttgctcggcggcgccagcagcgacgccgtggagatcgtcctgcccaagggcaagcaggtgcagatgcgcctggaattctgccgcctcaccgacaccggcgccgaagccggcacgatcaaggatgccggcgacgaccccgacgtgacccacggcgccctgctctattcccaggtgcgcctgagcccggacagcggcattcgtttcatcgccggccaaggcgtgggcaccgtgacccggccggggctggtgctgggtgtgggcgaaccggcgatcaatccggtgccgcgccggatgatcagcgagcacctggcaaccctggcccgggaacagggttaccagggcggcttcgagatcacggtcaacgtcgaggatggcgaagccctggcgctgaaaaccatgaacccgcgcctgggcattctcggcggcctgtcgatcctcggcaccagcggcatcgtgcggccgttttcctgcgcggcctatatcgcctcgatccaccagggcatcgacgtcgccaagaccaacggctacctgcacatcgccgcctgtaccggcaatgccagcgaagacaccatgcgccgcgtctacgacctgccggaaatcgccctgatcgaaatgggcgactttgtcggcgccgtgctcaagcacctgcgcaaagtgccggtggacaaactcagcctgtgcggcggtttcggcaagatcagcaagctcgcggccgggcacatggacctgcacagccgccattccagcatcgacctgccgcaactggccgaatgggccgcggcggtcggcgccgacccggcgctgcaaagcgccatccgcggcgccaacaccagccagcaggcgctggccatggccagcgccgccggcatcgccctgggcgacgcggtgtgccagcacgccctggacttcgcgcgcagcgtggtgccggcacaggtccaggtcgaagtcttcgccatcgatcgccagggcggcatcgtcggccatgccggcgcttttcgatgaagcgcatactgctgctgggcggcgtgaccgaggccttggccatcgcccggaccctggggccggagcacatctatagcctggcgggcatcgggcgcgtgcccactgacctggactgccaggtgcgggtcggcggctatggcggcgccgagggcctggcccggttcatccgcgagcaaggcatcgagctgctgctggacgccactcatccctacgccgccaggatcagccagaacgccgccacagccgcgcagctgtgtgacatcccctgctgggccctgcgccgaccggcctggcaagcgcaggccggtgacgactggcgcgaagtccgcgactgggccgacctggtccaggcactcgaacccttcaagcgcccgctgttcaccctgggccgcgagcccttgcagcatctgcatgagatccccgccggacagttctggaccctgcgcgccctcgacccgtaccccggcaatgaccggtgcgaagtgataggcgcacgcggccccttcctgatcgacagcgaacgcgagctgttcgaacgccgccgtatcgacgtgctgatcagcaagaacagcggcagcagcgccaccgaacccaagctggaagtggcgcgcgaacgtggggtgccggtgctgatcctgcaacggccatcgttgccagccgtcgatcgggaattccatgacctggacgagttgctccaggccctgcgctgaccgcctggccgcgcaaaacccggccgatacatcgagttaccaagtcccccgctgaacggtagggcgcagccctcgccgccgcgccacgggaccttcgcgtattgaagacagaggaaacacttgcggcgttggccacggacaggctttgcggcacgatcaaaggcctacccatatagtaacttatttgttacctttaaggccgacgatgattacagtcgaggaataccagcaagagaaccagcgcagccccttcggtcgctggttcgaaacgctggatacccaggcagccgtcaaggtttccaccgcgctgctgcgcctggaaatgggcaacacatccaacatcaagtggttcgacgggcttggcgaataccgcatcgattggggccccggctacaggatctacctgatccaggaaggccggcacctggtgatcctgtttggcggtggcgacaagtccacccagcaggccgacatcaggcaggcgaagaaactgatcgccgaattccatcaccgcaagaaggccgaactgaaaacgaggtgacacccatggcactgactcgaagcttcaagcacagcattgccgaacgcgccgagcgcgacccggcgttttcccaggcgctgctggacgaggctgctacgctgtttctcaacggcgaaccggagatgtcgcggatcattctgcgcgacctggtcaacgccaccgtcggcttcgaagccctggcccgcgagaccgccaagcccagcaagagcctgcatcgcatgctgtctgccagcggcaacccgagcatggacaacctggccgcgattttcgccgccatccgcgccaagctcggcgtggccatcgaggtccgcgcggtaccggctcactgaggaatggccaatccaggtggctctgcgacaccacaccgcacggcgcctttttacttatccacagcgatcaggctaaatacccccctgttcgctcaacctgacggatcgtcaccatgtcccgacaacggctcgcatttgcctggatcgcctgcttcgcagtgctgttcaacatgcttgccatgccgctttcgggagccctgcagcagaccgatcgagcacctgccgagcaactgttgtggggcagcttctgttcctccagcggcaccaagctggtggcgatctccctgggcaagctggaacagcaagccccgcagaacgacgatcactccaccatgcagcactgctggtgctgttccggctcggcgcccctggtcgccctgccaggccatgcgccgcagttgtatttcgcccgtttcgagtccaaccgcagcgtcgcgccacccgcgctggtcatgcccacgccacgccagcaatggccgagcctcaatccccgcgcttcacctctggtctgattccacctcgcaattgatctgcgtgtcgaatcgttctggagaactgccatgttgaaatccgtacaggccttgcaagccttgctgctggccgccctgctgttgcccgctggttttgccgccgcccatgaataccaggctggcgagttgcagattgcccacccctggtcacaggagctgccgcccaatgcaccgacggtggcggcctatttcgtcattcacaacaccggcaagaatgccgaccgcctgctcggcgtcgactcgccgatctcgggcaaggccgagttgcatgaacacgtgcagcagggcgacctgatgaagatgcagcaggtgcccaacgtggcgatcgccccgggcgcgaccgtcaccttcgcccccatggcctatcacgtgatgctgctggagctcaaagaccgcagcctgctcagcgacggcaagcgcttcccgctgaccctgcacttcgagaaatccggcgacgtcacggtcgaagtggcggtgcagaagcaggcgcccgcgggcagccaggaacacatgcacgcccaataagccccggccatcgttaccgtgaacgccttgcgctcgcccggcacccggcgatccgtgcgcacgcccgtgaaagtacggcgcggcagctggatcagcttgttcgccatgctgatgatctttatcggtccgctgatttcccagtcgatgccgatggatcaggccatgccgatgaacctgtccatgtcgatggacatgggcgagcccggctgccacggtgaaaaccctcacggcacggagcacggcaaggtccagggcgaacaccatgcgctctgggaaaaatgcggttactgcagcctgctgttcaactgcccggcactgcctggcagcctgtcgttcacggcgctcgacaattcgccgtccagccacttcctcaccccctcgccgcgcctgggccatgcccggcagacggtgttccccggcgcccggacccgcgccccgccagtcattgcgtaaacctctcaaccgcacttcacccggccgactgtagaaaagacagccgcaggctgctggccgtgttgtttacgaaatgattgatggaacctttatgtccaggttttctgctgacactcgcctgtgctccgcccaggccctcgctacctttgccctgaaccaacctcgcgtacgtttcaaccacgccatcgccctgctctgcggtgccctgctcacgccgctggccctggcggccgaacaaccggtggatcacagccagcacggcgaagaactgagcccgacggtgatcaccgccatcgcccccagctcgccgctgaccgtggtcaccaaccccaaggatccgcgccagccggtcccggccagcgatggtggcgactacctgaagaccattcccggcttcgctctggtgcgcaacggcggcaccaacggcgacccggtgctgcgcggcatgttcggctcgcgcctgaacatcctcaccaacggcggcatgatgctcggcgcctgccccggccgcatggacgcgccgacctcctatatctcgccggaaacctacgacaagctgacggtgatcaaaggcccgcaaaccgtgctctggggcccgggcgcttcggccgggaccatcctcttcgaccgcgagccggaaaacttcggcgagctgggtacccgggtcaacgccagcgtcctggccggctccaacggccgcttcgacaaggtggtggatgccgccgccggcggaccgctgggttacgtgcgggtgatcggcaaccaggcccattccgatgactacaaggacggcaacaacgacaccgtgccgtcgcgctacgacaagtggaacggtgacgtggccgtgggctggaccccggacgccgacaccctgctggaactcaccgccggcaagggcgacggcgaagcgcgttacgccgggcgcggcatggacggctcgcagttcaagcgggaaagcctgggcctgcgtttcgagcgctccaatatcggcgaggtgctggataaggtcgaggcgcaggtctactacaactacgccgaccacgtgatggacaactacagcctgcgcacgccgtccggcaccgggatgatggccggccccatggccagcaacgtcgaccgccgcaccctcggcgcgcggatcaaggccacctggcgttgggccgatgtgcagttgatcagcggtatcgacgcgcagaccaacgagcaccgtcagcgcaaaggcatggggatcgacacctataaggaccaaccacgcaccaaggacgccgacttccataattacggcgcattcggcgaactgacctggtacgccgccgaccgcgaccggctgatcagcggcgcccgagtggaccgtgcctcggccaaggattatcgccagagcatcggttccggaatgatgacccggcccaatccgaccgccggcaatacccgcgccgacaccctgcccagcggtttcatccgctacgagcatgacctggccgacagcccgaccacggtctatgccggcctcggccacgcgcaacgcttcccggattactgggagctgttctcaccgaagatggggccgtccggatcggtcaacgccttcgattcgatcaagccggaaaagaccacccagctcgacttcggcctgcaatacaagaccgcggaactggaagcctgggcctcgggctacatcggccaggtacgcgactacatcctgttcaactaccgccccgggatgatgggcatgacctcgcaagccgagaacatcgacgcccgcatcatgggcggcgagctcggcgcggcctacaagctgaccgacaactggaaggccgacgccaccctcgcctacgcctggggcaagaacagcagcgacggctcgccgctaccgcagatgccaccgctggacgcgcgtttcggcctgacctacagcgcggacaactggagcgcaggtgccctgtggcgggtggtggcggcgcagaaccgcatcgatgaaaacaagggcaacgtggtcggcaaggacttcggcaagagcggcggcttcggcgtgttctcgctcaacggcgcctaccggatcaacaagaacctgaaggtcagcaccggcgtcgacaacctgttcggcaaggcttacgccgagcacctgaacctggccggcaacgccgggttcggctacccggccaatgacccgcaagccatcaacgaaccggggcgcacgctctggaccaaggtggatctgagcttctaaacacaacaacaaatggaaccgctgccgaaaggctgcgataaggccgaaggccttcagcgctattgagtacgttgcggccgttccggccgatcgcagcctatcggcagcggctacagagaataattgcccatgcggagcgttccctgatgagccaaccgaaagtgtctttctacaacctggcctggcgctggcatttctacgccgggctgttcgtggccccgttcatggtgatgctgtccctgaccgggatcatctacctgttcaaaccccagctcgacccgcttatgtacggccacctgctgcaggtgccggcggggcaccacatgctcagcgccgatgagcagctccagcgggtccgggccgcgtatccccaaggccatgtcaaacagtacctgccgccgctcgaagccgggcgcagcgcgcagttcgtggtgcagaaggaaggtggcgaactcaatgtgttcgtcgaaccttaccacggcaatatccttggcgagcaagacgccaagaacaatctgcaagccatcgcccggggcattcatggcgagctgatgatcggcaccctcggcgaccggctggtggagctggcggcgggctggggcatcgtcctggtggtgtccgggctgtacctgtggtggccgcgcggcaagtcttcggccggggtgttgtggccgcggttcagcagccgcggtcgtgtgctgtggcgcgacctgcacgccgtggtcggcttctggggcgcggcgttcctgctggtgatgctgctcagcggcatgacctggaccggcttctggggcaagcaatacgccgagctgtggaatcgcttcccggcggcgatgtggaacgacgtgcccaagtccgaccagcaggccggcgaactcaacaccgccagccgccagaccgtaccctgggccatggagaacacacctatgccgatgtccggcgaccatgccgaacacatggcccacggcgccgcgcacgaaggtccggcggcgcccgcggtcagcctgcagcaggtgcaggacatcgccacccagcgccaggtcgaagccggttacagcatcaccctgccgaccagcgccagcggcgtgttcaccattgccgtgttcgccgacgacccacgcaacgacgccaccctgcatgtcgaccagtacaccggcaaggtcctggccgatgtgcgctggcagcagtacagcaacgtcgcccgcgccaccgaagtcggggtgatgctgcacgaaggcaagatgttcggcccgttcaaccagatcgtggtgctgctgatctgcctgatgattctgctgagcgctgtcagcggcctggtgatctggtggaagcgtcgtccccaggggcgcctcggtgtaccgccgctgcgccatgacctgccgaaatggaaaaccgcgatggcgatcatgctcgcgctggccgtggcctttcccctggtcggggcctcgctggtggccgtgtggctgctggatcgcgtgctgttgtcgcgctggaaccgctcgactgaatcggcctcatcttcattatgaatcaggcgagatgcgcggtttagagggatctgtagactgctgtcggttcaatttccgacacacataatgttactttgtaacattaaagtgtaagattccctacccgcagccacccatgctgcgggtaaccctctcgaagaagcgactcagccgccccgatgaaccgcccgacaaacaagctcctggcgtccagcctctgcctgctggccctgaatcactccgcccaggccgacgacacgcccctgacgctgcccaccggcaccatcagcgcgcccgccatcgacgcgcaggacatcagcctgcacaccccgaccaccgccggttcgcgcctgggcctgagcgccctgcaaaccccggccagcaccgagagcctgagcggcgagcgcattcgccagcgtggcgaccgcagcgtgcaggacgcggtgtcgcgcggcaccgggatcagccgtaccggcacacccggcgacggcggtacttcgctgtcggcgcgcggctttaccggccagggttcggtgatgcagctgtacgacggcaatcgcctgtacagcggcatgggcaccgtgaccttcccggtggacacctggtcggtggagcgggtggatgtgctgcgcggcccggcctcggtgctgtatggcgaaggcgccaccggtgcggtggtcaatgtgatcccgaagaaacccttcgccggcgagatcgaaaaccacctgcgcctcggctacggctcctacgacagccagcagcaggccctcgacagcggcggctcgctgagcgacaccctgagctatcgcctgaacctcaaccgcctgcgcagcaacggctggatcgatcgcggcgacagcgccagcgacttcatcagcgcggcgctgcgctggcaggccacggacgacctggcattcaccctcgcccacgactacggcgaccagcagccgatgaatgatttcggcaccccgctggtcaatggccgcttccatgagggcctgcgggacaagaactacaacatcggcaacgacaagcagcactacaacgatcagtggacgcgcctgaccagcgagtggcagctctccgacgccgtcagcgccagcaacgagctgtattacctcaaggcccagcgccgctggcagaacgccgaaaactacaactgggacaccactggccagcagcttctgcgcagcggcaacttcgccatcaagcaccagcaggagcaggtcggcgatcgccaaaccttcaccttcaagcacggcctgttcggcctcgacagccagaccctggccggggtcgattacaaccgcatccgcttacagctcaacagcaactcgccgttcaaggatgtgctgccggatggccagccgctggatctgcaacacccggacaagggccgcttcgacagcgcctcggcctatcgcccacagttccagagcaccaccaaacagatgtcggccttcgccgaaaaccgtacccaactgagcgagcgctggtcgctggtgaccggcgtgcgccgcgactacgtgcaggtggatcgcgacaacctggtggacggcagccagagcgacaagaccctgaccggcaacaactggaaggccgggctggtgttcgcgctgacgccggacacctcgttctacggccagtacgccaccagcaccgacggcgtcggcggcctgatttccctgagcccgagccagcagcaatacgacctggcccgcgcccggcagagcgagatcggcctcaagcagatgttctgggaccagcgcggcgagtggaccctggcggcctatcacatcgtcaagaagaagctgctgaccgacgacccgggcaacccgacgctcaagcagcaggtcggccagcagtcgtcccgcggcctggaggccagcctcgacctgcaactgccccacgcctggcaactgcaagccaatgccgccatcgtcaaggcccggtacgacgacttccaagagcaggtcggcaaccagttcgtctcgcgcagcggcaatcgcccggtggacgtgccccggcgcaccgccaacctgtggctgaacaaggcagtgaccgataacctgcgggccggcgccggggtgcgttatgtcgatgcccgctacgccgacctggccaaccgcaacgagctgcccagctacaccgtggtcgacgcggtgttgtcgtgggaagccctgcgcgacaccaccttcggtttgcagctgaacaatctgttcgaccggcagtacgcgcaaagccaatacaatgagggccagcaatggatcctcggcgaaccacggtcgtttttcgtgaccgccgattacaccttttaaccaatacctgtagccgcggccgaaggctgcgatcggtctgggcggcattccgacgtagcgcacgcgctcttgaggtcctcggaaggtcctgcggaccttttcgcagccttcggcagcggctacagggaatcatatggaccccgcatgacctcgctgaacctcaccaacctggcctggacacccctgggccagggccactgtcatcaccagttccagctgcgtgaggccagcctgcgcgtggcgccgggggagttcgtcgggctgatcgggcccaacggcagcggcaagaccagcctgctgcgctgcagctatcgcttcagccggccggaccagggcgaagtccggctcgatcactacaacgtctggaagcagacaccgcgctggtgcgcgcaacgcatcgccgtggtgttgcaggagtttcccgagtccttcggcctgaccgtcgcagaagtggtcgccatgggccgcaccccgcacaagggcctgttcgacggcgacagcaccgcagaccgcgccatcgcccgccaggcgctggagtcggtgggcctgctgggtttcgaggcgcatgccttcgccaccttgtccggcggggaaaagcagcgggtgatcctggcccgcgccctggcccagcaaccacaactgctaatcctcgacgaaccgaccaaccacctcgacccgcgctaccagctggagctgctgcaacgggtcaagcgcctgggcatcggcaccctcgccagcatccacgacctgaacctggccgccgccttctgcgatcgcctgtacgtgatcgatcacggacgcatcgtcgccagcggcacgcccgagcaagtgctgacagtcacgctgctgcgcgaggtgttcggcgtcgacgccctggtcgaccaacacccgctgtccggctacccacgaatcacctggataacccaaccatgaccccgcgcgtctcactcaactgcctgatccctgccggcctggccctgtcgctgctcgccggccaggcctgcgccgaagccacccgttacccgctgaccgtccacagttgcaaccgcgaggtgaccttcaaggaagcacccaagcacgccctgagccacgacatcaacatgacccagatgatgctcgccctgggcctcaagtcgcgcatggtcggctacagcggcatcagcggcatcagcggctggaaggcggtgacgcccgagatgcaggccatcctcgacggcctgccggagctggcggccaagtacccgtcggtggaaaccctgctcgacgccaatgtcgatttcttcttcgccggctgggactacggcatgcgcgtcggcggcgacctgaccccacagaccctgacgccgctgggcatcaatgtgctggagctgaccgagtcctgcgccttcgtgatgaagcgcccggccgccagcctcgacgacacctacaacgacctgcgcaacctcgggcggatcttcgatgtgcaggaccgtgccaaccagttgatcgccgagatgcagcaacaggtcgccgcgatccagcaggacctgcccacggaaaaaccgcgggtgttcctctacgacagcggcgaggaccgcgccatgacctccggccgcctgggcatgccccaggcgctgatcgatgccgccggcgggcgcaacatcctcgacgacgtcgaggccagctggacccgggtcaactgggaaaccgtggtcgaacgcaacccgcaggtgatcgtgatcgtcgactacagcgaagtcactgccgaacagaaacagcagttcctgctcaacaacaaggcgctgcaatcggtggatgcgatccgtaaccagcgcttcatcgtgatcccttacgtgcaggccacgccgggcatcgataacgtcgaagcggtgcaaaccctggccaagggtttccacggcgcatgatcgatcgtcgttatgccttgttgctgactgccctcggcgcgttgctgctggcgtcctgcgtgctgtccctgggcttcggctcggcgcgggtgccggtggatgtggtctggcggatcctgctgcacaagaccctcggcctgggcgaggcggactggagcgccgggcaggagcatatcgtctggctgatccgcgtgccgcgcatgctgctcggggccctggtcggcgccgggctggccttgatcggcgcggtactgcaagcggtgacgcgcaatccgctggccgacccgcacctgctcggcgtgacctccggcgccaccctgggcgcggtgatcgtggtgctgcatgtgggtgaaatcgtcggcctgctgaccctgcctatcgccgcctttatcggcgcgttggcgagcatgctgctggtgctcggcatcgccgcgcgtcacggccggctcgacagcgaccgcctgctgctgtgcggggtggcggtgtccttcgtgatgatggcggtggccaacctgctgctgttcatgggcgaccaccgcgccagctcggcggtgatgttctggatgctcggcgggctgggcctggcgcgctgggaactgctcgcggtaccggcggccagcgtgctgctcgggctggtcctgctgctgggcatggcacggccgttgaacgcgctgatggccggcgagcagaccgcggtgaccctcggcctgaatgcccgcaacgtgcggctgcgggtgttcctgatcgcttcgctgatgaccggggtgctggtgtccatcagcggctccatcggcttcgtcgggctgatggtgccgcacattgcccggcgtcttgtgggtgccgagcatcggcggctgttgccggtgtgcgtgctgctgggcagtgtgttcctggtctgggtcgacgtcgccgcccgcaccctgatcgcccccgaagacctgcccataggcgtggccacggcggccatcggtgggctgttctttatcggcctgatgcgccgccgctgaaaaagcggtgtgcctgatgcgccgccatcgcgggcaagtcggatcgccgcccgctcgctcctacagaagagcaacgtgctcggtttcacggacaacgccctgtagccgctgccgcaggctgcgataaggccgaaggtctttggcgatcttgaagccgtgcgcgcccttcggtcgcgatcgcagcctgcggcagcggctacagatcatcaccggcaccagcgcggcgcattcgtgcgcaccaaagacgcctgatggccccgcattggtgcgccagccctctcccctgctccgtaaaagcgacgttttcatgccctgtgccgactaggcacaccccttgcaaaacagcccttcagtagtccgcatctgccaaccaagaaaactcataagttcatggagatcgcacaatgaagcgtcgcagcttgatcaaggctttcacactcacggcaagcattgccgcgatgggcatgacctggaccgtccaggccgccgagaccatcaaggtcggcatcctgcattcgctgtcggggaccatggcgatctccgaaacctcgctcaaggacatggcgctgatgaccattgacgagatcaacgccaagggcggcgtcaacggcaagcagctcgaggcggtggtggtcgacccggcgtcgaactggccgctgttcgccgagaaaggccgccagctgctgacccaggacaaggttgccgtggtgttcggctgctggacctcggtgtcgcgcaagtcggtgctgccggtgttcgaggaactcaacggcctgctgttctacccggtgcaatacgaaggcgaagagatgtcgccgaacgtgttctacaccggcgcggcgcctaaccagcaggcgatcccggcggtggaatacctgatgagcgaagacggcggcagcgccaagcgcttcttcctgctcggcaccgactatgtctacccgcgcaccaccaacaagatcctgcgctcgttcctgcattccaagggcgtggccgacaaggacatcgaagaggtctacaccccgttcggccacagcgattaccagaccatcgtcgccaacatcaagaagttctccgccggcggcaagaccgcggtcatctccacggtcaacggcgactccaacgtgccgttctacaaagagctggccaaccagggcctgaaagccaccgacgtaccggtggtggccttctccgtgggcgaggaagaactgcgcggcatcgacaccaagccactggtgggcaacctcgcggcctggaactacttcgagtccgtggagaacccggtgaaccagaagttcgtcgccgactggaaagcctacgccaaggccaagaagctgccgggcgcggataaagccgtgaccaacgacccgatggaagccacctacgtcggcatccacatgtgggcccaggcggtggagaaagccaagtccaccgacgtcgacaaggtccgcgaagccctggccggccagaccttcgccgcgccgtcgggctacaccctgaccatggacaagaccaaccaccacctgcacaagccggtgatgatcggcgagatccagccggacggtcagttcaacgtggtctggcagaccgaaggcccgatccgcgcccagccgtggagcccgttcatcccgggcaacgacaagaagccggactacgcggtgaagagcaactaagcaacggatggatgccggccgccgctcccgcgtccggcacaacctctgtagccgctgccgcaggctgcgacaggtccgcaggaccttgaggccctcgagagcacgtcctctgcgaggccgatcgcagcctgcggcagcggctacagacccacgctccgcgcaaggccattgacatgcccactgccctctaccgtttcatcctcgcctgcctgctgttgctgccattggccgccagcgccggcgacgccgaagacttcgtcgcggccaacgccacgcaacaggccaggctgctggaaagctgggccgcgcagcccgacccggctcgcctcgaactgctcggcgccttgcagcaaggccagctgaccgtcgatgggcaagccaagaccttgcgcctgaacaatcgcctgcggggtctgatcgacaccgccatggccagccatcaactgctcgccgccgacgcaaagatccgtctggccgccgcgcagcagttgcagaaaagcgccaagccggcgcagctgaaattcctcgatgccagcctggccgccgaacaggaccaggccgtacacgacgccctgagcctggccctggccaacctgcaactggtggacagcgacccggccgtgcgcctggccgcggtgcgcctgctgggtgaaaccggcgacccgctggcccgcacccgcctcgagggcctgctcgaacccggcgtggaagccgatgccggggtgcgcaccgccgccgaaaccagcctggcccaggtcaagcgcaagctgctggtgggcgaggtgctcggccaggccttcagcggcatgtccctgggctcgatcctgctgctggcagccctgggcctggcgatcaccttcggcctgctcggggtgatcaacatggcccacggcgagatgctgatgctcggcgcctactccacctacatggtgcagctgctgttccagcgctacgccccgcaggccatcgagttctacccgctgatcgccctgccggtggcgttcttcgtcaccgccggcatcggcatggccctggaacgcacggtgatccgccatctctacggccggcccctggaaaccctgctcgccacctggggcatcagcctgatgctgatccagctggtgcgcctggtgttcggcgcgcagaacgtcgaggtgtcgaacccggcctggctgtcgggcgggatccaggtgctgcccaacctggtgctgccctacaaccgcatcgtgatcatcgctttcgcgctgtttgtggtggtgctgacctggctgctgctgaacaagacccgcctgggcctgaacgtgcgcgcggtcacccagaaccgcaacatggccgcctgctgcggcgtaccgacaggacgggtcgacatgctcgccttcggcctcggttccggcatcgccggcctcggtggcgtggccctcagccagatcggcaacgtcggcccggacctgggccagagctacatcatcgactcgttcctggtggtggtgctcggcggcgtcggccaactggccggtagcgtgttcgccgcgttcggcctggggatagccaacaagattctggagccacagatcggcgccgtgctcggcaagatcctgatcctcgcgctgatcattctgtttatccagaaacgtccgcaaggcctcttcgcattgaaaggacgggtgatcgactgatgaatcagcctctattggttaccgctacacaaaaggccgggcccaaggtctcggtcgccgtcggcgcgctgatcctggcggtgctgctggccctgccgctgctctcgctgctggcgccggacaacccgctgcacgtctcggcctacaccctgaccctggtgggcaagatcctctgctacgccatcgtcgccctggccctggacctggtctgggggtatgccgggctgctgtccctgggccatggcctgttcttcgccctcggcggctacgccatgggcatgtacctgatgcgccaggccgcgggagacagcctgccggcgttcatgaccttcctttcgtggaccgagctgccctggtactggagcggcaccggcagcttcctctgggccctgtgcctggtggtgctggcgccgggcttgctggcgctggtgttcggtttcttcgccttccgctcgcggatcaagggcgtgtatttctcgatcatgacccaggccctgaccttcgccggcatgctcctgttctttcgcaacgagaccggctttggcggcaacaacggcttcaccaacttccgcaccatcctcggcttcggcatcaccgagcctgggacccgcgcggtgctgttcctggccaccgtgctgttgctggtggccagcctgtatatcggctggcgcctggcccggagcaagttcggccgggtgctgaccgcgctgcgcgatgccgagaaccgcctgatgttctgcggctacgacccacgcggcttcaagctgttcgtctgggtgctgagcgcggtgctctgcggcctggcgggggcgctgtacgtaccgcaagtgggcatcatcaaccccagcgaaatgtcgccgaccaactccatcgaggccgccgtatgggtcgccctgggcggtcgcggcacactgatcggcccactgctcggcgccggcgtggtcaacggcatgaagagctggttcaccgtggccttcccggaatactggctgttcttccttggggcgctcttcatcatcgtcaccctgtatttgcccaaaggcatcatcggcttgctgaagaaaaggggcgaatcatgagaatcacagcgacggccgaattcatgctcgaacctatccttgagcccaacaaagacgccggcagcagccgcgacgccatcggcctcggccaggctgccggcaagggcctgaacacccgccacggcaccatcctgaccctggaagacatcagcgtcagcttcgatggcttcaaggcgctcaacgacctgaacctgtacatcggcgtcggcgagctgcgctgcatcatcggccccaacggcgcgggcaagaccaccctgatggacgtgatcaccggcaagacccggcccacccacggcaaggcctggttcggcgaaaccctggacctgacgcagatgagcgaggtgcagatcgcccaggccggcatcggccgcaagttccagaaacccacggtgttcgaagccctgagcgtgttcgaaaacctggagctggcgcagaacaccgacaagtcggtgtgggccagcctgcgggcgaaactctccagcgagcagaaagaccgcatcgacgaagtgctggaaaccattcgcctgaccgcctcggtggaacgccaggccggcctgctgtcccacggccagaagcagttcctggaaatcggcatgctgctgatgcaggacccgcagttgctgctgctcgacgagccggtggcgggcatgaccgatgccgagaccgagttcaccgccgagctgttcaagcgcctggcgggcaagcattcgctgatggtggtggaacacgacatgggcttcgtcggctcgatcgccgaccacgtcaccgtgctgcaccagggcagcgtgctggccgaagggtcgctggagcaggtgcaggaaaacgaaagggtgatcgaggtctatctcggccgctgacagctccttgtaggagcgagcttgctcgcgatggaggtcaacgataacgcgcgctacctggatgagcgcgccgttctcaggctcttcgcgagcaagctcgctcctacaaaaagaattaaaggaaaaaccagacatgctgcaagtcgacacgctgcaccagtactacggcggtagccacatcctgcgcggcctgagcttcgaggcgaaggtcggcgaagtcacctgcctgctcggacgcaacggggtgggcaagaccaccctgctcaaatgcctgatgggcctgctgccggccaaggaaggcacggtgaactgggaaggccaggccatcaccgcctacaagccccatcaacgggtgcatgccggcatcgcctacgtgccccagggccgggagatcttcggccgcctgaccgtggaagaaaacctgttgatggggctttcccgttttggcgcgaaggaggccaaggaagtgccggccttcatctacgagctgttcccggtgctgctgcaaatgaaacagcggcgcggcggcgacctgtccggcggccagcaacagcagttggccatcggccgggccctggccagccggccacggctgttgatcctcgacgagcccaccgagggcatccagccgtcggtgatcaaggaaatcggcgcagtgatcaagaaactcgcggcccgcggcgatatggcgatcctgttggtggaacagttctacgacttcgccgccgaactggccgaccagtacctggtgatgtcccggggcgaaatcgtccagcagggccgcggtgaaaatatgcaagccgagggtgtacgcggcctggttaccatctaagttacgatctagcctgtaacgtccagacactaagcacaaaccatgaacctgccagcccacaccgccctgttcacccccagctggcacgccgagctggaactcggctacgcccgctttggcgacagcacacgcccggtgcagcgccggcacaagggcccgctgcgggtgcagaagcacctgtacgccgaaggccccgaagtctgccagcacatcatcgtgcatccgcccggcggaattgccggcggcgaccgcctgcagatccgcgccagggtcgagcgcgatgcctgggcgcagctgaccagtcccggcgccgccaagtggtatcgcgccaacgggcccgcctatcagaccctggaattgaacgttgccgccggcgccaccctggaatggctgccccaggaaaccatcgtgttcagcgccgcccaggccgaactgagcacccgtatcgagctgcacggcgacgcccggctgttctactgggacgtggtggcgctcggccgcccggccagcgacgagcgcttcgacctcgggcatttccagtcgcacctggacatccgccgcgacggccagttgctctggcacgaacgccagcgcatcggcggcggtgacggtttgctcgactcaccgatcggcctggacggccagccggtcttcgccaccctgctggccaccggcgaaatcgacagccagttgctggagcgttgccgttcgctgcctcatgccgtgcgcggcgacctgacacaactgcccggcctgctggtggcccgctgcctggccagcgaagcgctgctggcccgcgcctggctgatcgacctgtggcgcctgttgcgcccggccctgctgggacgcgaggcgctgccgccgaggatctggaacacatgacacagcgacacgactttcctgtagccgctgccgcaggctgcgatcgtccgcgtagcgggcgccaaaccagacgccgtggtgtatcaggcagatcgcgtcaaccagggtgcgtctcctgcggagccgatcgcagcctgcggcagcggctacggatgcatcgcgccatgccctctttcaactgctcaacaacggattttgaacgatggacctgaccccacgcgaaaaagacaaactgctgatcttcaccgccggcctggtggccgaacggcgcctggcccgtggcgtgaagctcaattacccggaagccatggcctacatttccgcggcgctgctcgaaggcgcccgcgacggccagaccgtggccgagctgatgcactacggcaccaccctgctgacccgcgaacaggtaatggaaggcatcccggagatgattccggaaatccaggtggaagcgactttccccgacggcaccaagctggtcaccgtccaccaaccgatcgcctgaggccgcccatgacgtattccatccgcgatgcggtgcatgccgacctgccggcgatccgcgatatctataacgacgccgtactcaacaccacggcgatctggaacgaacaggccgtggacctgggcaatcgccaggcctggttcagcgcccgccaggcccagggttatccgatcctggtggcggtcgacgccgacgaaagcgtgctcggttatgcctcgttcggcgactggcggcccttcgacggcttccgccataccgtcgagcactcggtctatgtgcgcaacgaccagcgcggcaacggcctcggcccgcgcctgatgcaagcgctgatcgaacgcgccaaaagctgcgacaagcacgtgatggtcgcggccatcgaaagcggcaatgccgcctcgatccgcctgcacgaacgcctgggcttcgtcaccaccggacagatgccgcaagtgggcaccaagttcgggcgctggctggacctgacgttcatgcagctgaccctcgatccgggggcgccaccgcccaccatccacaaggagtgatacccgatgaacgccgcccaactgcgtcgagtccatgcggagagctttgcccactatcgccaggggttgattgatctgttgttcgacgccgtgggccatggcgcctcggtcggtttcatggccgacctcgacgaggaacaggcccgcgcctacgtcaacagcgtccaggccagcgtggccgacggcagcctgctgctgtgggtggtggtgcaggacgagcgggtcctggccagcgtgcaactggcgctgtgccagaagcccaacggcctcaatcgcgccgaggtacagaagctccaggtgcgccacgacgcccgccgccgtggcatgggccagcagttgatgcacgctgtggaacaggccgcgcgccagcacaagcgcggcctgctgtacctggacacccaggccggctcggacgccgaagccttctacagcgccctgggctacacccgcgtcggcgaactgccgaactactgccaaagcccggacggcacctacagcccgaccgccatttacttcaagactctggggcaacccatatgattccaggccaataccagatccagcccggcgacatcgaactcaacgccggccgccgcaccctcagcctgagcgtcgccaacagcggcgaccggccgatccaggtgggctcgcactatcactttttcgaaaccaacgacgccctgaccttcgaccgcgccgccagccgtggcatgcgcctgaacatcccggccggcaccgccgtgcgcttcgagccggggcagacccgcgaggtggaactggtggacctggcagggcatcgccgggtgttcgggtttgccgggcgggtcatgggcaacctggactgatgcaatcccggtagccgctgccgcaggctgcgatggctgcgcagcggcccctgcatttcaaagcgaacgaaggtccttcggcccttagcgcagccttcggcagcggctacaggtgcccgactcaattcttaggaaggtgcaatgaagatttcccgccaagcctacgccgacatgttcggccccaccgtcggtgacaaggtgcgcctggccgacaccgagctgtggatcgaagtcgagaaggacttcaccacctacggcgaagaagtgaagttcggcggcggcaaggtgatccgcgacggcatgggccagggtcagctgctggcggccgaggtggtcgacaccctgatcaccaacgcgctgatcatcgatcactggggcatcgtcaaggccgacgttggcctcaaggatgggcgtatcgccgccatcggcaaggccggcaacccggacatccagcccgacgtgaccatcgccgtcggcgccagcaccgaagtcatcgccggcgagggcatgatcctcaccgccggtggcatcgacacccatatccacttcatctgcccgcagcagatcgaagaagcgctgatgagcggcgtcactaccatgatcggcggcggcaccgggccggccaccggcaccaacgccaccacctgtacctcgggcccctggcacatggcgcgcatgctccaggcggcggacgcgttcccgatgaacatcggctttaccggcaagggcaatgccagcctgccggaacccttgatcgagcaggtcaaggccggggccatcggcctcaagctccacgaggactggggcaccaccccggccagcatcgacaactgcctgaacgtcgccgaccagtacgacgtgcaggtggcgatccacaccgacaccctcaacgagtcgggcttcgtcgagaccaccctcggcgccttcaagggccgcaccatccacacctatcacaccgaaggcgccggcggcggccacgccccggacatcatcaaggcctgcggtttgcccaacgtgctgccgagctcgaccaacccgacccggccgttcacccgcaacaccatcgacgaacacctggacatgttgatggtctgccaccacctcgacccgagcatcgccgaggacgtggccttcgccgaaagccgcatccgccgcgaaaccatcgccgccgaagacatcctccacgacctgggcgccttctcgatgatcagctccgacagccaggccatgggccgggtcggcgaggtcatcacccgcacctggcagaccgccgacaagatgcatcgccagcgcggcccgctgccgggcgacggcgccggcaacagcaacttccgggtcaagcgctacatcgccaaatacaccatcaacccggcgatcacccatggcatcagccacgaagtgggctccatcgaaattggcaaatgggccgacctggtgctctggcggccggcgttcttcggggtcaagccgacgctgatcctcaagggcggagccatcgccgccagcctgatgggcgatgccaacgcctcgatcccgaccccgcagccggtgcattaccggccgatgttcgccagctacggcggcagccggcacgccaccagcctgacctttatcagccaggccgcgctggcggccggggtgccgcaacaattggggctgaaaaagcagatcgcggtggtcaagggttgccgcgacgtgcaaaagagcgacctgatccacaacgactacctgccggatatcgaggtcgccccgcagacctatcaggtcaaggccgacggcgtgctgctctggtgcgaaccggcggacgtgttgccgatggcgcagcgctacttcctgttctagggtctgtacgaaaagtcggcgagcgaaggtcaggcaaggcgcaacgaccaacgggagtaacagccaagggctggcccgaagggtgagcgcagcgaatcaaaacaggcaaggagcggcgggggtcgcgttcgactttaggggcctaaatgagcattccgatcggactcgcgcacgagcctgtttctgcgtaacgccgcaggcgtctagcgcgcagcatggtctgcgtagtgccgaaggcgcccagcgcgcagccacttttcgtacagagcctagaaacctggatccaacgggcgcccatccgggccgcccaacggtcagcaaagccggacgtcttgctgtgttgaacggctcaatcgcggctagaattcgacaggccgtcctcacttttgctgcctgacaaggttcccggccatgcgtctacccgacttcatcgtgcaacacgttgatcgaatcgttgatgagtgggagcaattcgcccgatccatcgcccccgaaaccgactccctgacccgcctgcaactgcgtgaccacgccaagtccatcctgctggccgccgctcgcgacatgcgcaccgcccagaccgccagcgaacaggcggccaaggccaggggcgaaggcccggagaacagcccaagcctcgacgaagccgccgccagccatggcgagttgcgccacaacgtgggcttcgacctggtgcagatgacctcggaattccgccacctgcgcgcctgcgtgatccgtctctgggtctcccgcctggagtcgccacagctggcctatttccaggacatgatccgtttcaacgaagccatcgacgaagcattggccgagtccaccacggcctatgccgaacaggtcaaccgttcgcgggatatcttcctggcgattctcggccacgacctgcgtacccccttgcaggcggtgagcatgtccaccgaaatgctggcgcgcaaagtcgcgctggatgccgatgcgctggcctatgtgtcgcggatcaagagtggcgccaggcacatggcggcgatggtcggcgacctgctggagttcgtccgcagccgcctgggcagcagcctgcccatcgagccggcgcccatggacatggccagtgccatcaaggcagccatggacgaagcctgcgctggccagccggactgcacgccagcgctgaacttccatggcgacagccatggcatctgggatcgcgggcgcatcgagcagatgctgcagaacctgatcggcaatgccctgcagcacggcaacggcaaccgcaccgtgaccgttaccctcacgggtggcgccgaacaggtgctgctgaccatccacaactacggcccgccgatacccaaggaagccttgagtagcctcttcgatccgctggtgcgcagcgccaacgaagaactcggcagcccctccaccagcctcggcctgggcctgttcatcgtcaaggaagtggtcaccgcccaccagggcagcatcggggtcagctccagcgaggcagatggcaccaccttcaccgtgaccctgccgcgggtgtcccacgccaaatagtcgtagagagcaaattgctgacacctctgtagccgctgccgaggctgcgaggctgcgctcgaccgcgaagcggtcgtaaaccgggcactgctttccttcaggtaaaccgctaatgcaggttttgcgaggactgcgtcctcgaacgtagctcgcgaattcggcaacggctacagacgctcgtcagtcgctgagcaaacgccccaggcgctgcttgagcatctggttttccgtgcgcaactcacggacttcgtcgagcagttccagcgccagggcgacgccttcccactccagttccagatcgcgccgcaacttggcggcgcgcttggcgaccgccagttcgtaatcggtgaaacgccagtcccgtggcgccgagccatggggatcgaggatcccgtgctcgacgatttccatcacataggcggccggcagatcggccacctcgcagaactcttccatatccagctgaacgatcagggtgctcatggttagcgactccttgtttcagatcagaatgggttgcagatcagaaatgctcccgcggattgaaggcggcctttttcgccagctcctgccacagcgccttgacgtcgtcgccggaggccttgggcatcacggccttgagctgcacgaacagataaccgcgatgcccggccttgttcagcaggccatggcccttggcgcgcatgcgttggccgttctggctgccggccggcaccttgaggttgatcttgccggtcagggtcggcaccgcgacctcggtccccagcgccagctcccaaggggccagcggcaaggtgatgatcaggttctcgccctcgatatcgaacttcggatggggcgcgaaacgaatggtcaggtacaggtcgccattggccccgccgccgacacccggcgcgccctggcccttgagccggatgcgctcgccgtcggtgacgccggccgggatcttcacgttcaggctcttgctggtgttgctgacgtgctggccggcagcgttgtactgcggcaccttgaagctgacctttttcgactcggccgacagggtctcttccaggaagatcggtaattccatttccacgtcttgccccctgcgcccggcgctgcgcgattgtccaccgccgaaacccggcccgcggttgccgaagatcgaactgaagaagtccgaaaaatccccgccatcgccgaaaccgccggcatccgcgtggcccttccagcccggtgggccctggaacggctggccgtgctggccataacgccgcaggtcgtcgtattcggcccgcttgtccgcgcttttcagcgcttcgtaggcttccgacgcgtccttgaacttggcttcggcgtctttttccttgctgacatccgggtgatatttgcgcgccagcttgcgataggcggccttgatcgccttgtcgtccgccgtcggctccaccccgagaatcttgtaatagtctttgaagtccatctaaggatcaccatccgttatcaatgtggcgcggcgggatgtacagcatgcactcttgaacagcgtcaaggctgatcgatctcaatactgtgactcacgcggcgcagcagaagtttatcggcagctggcggcggttcttgcgaccgcccgatggctgcccggcccatgcctgcaagtttggggtgaagaatagtctttcaaggcttgcgggttacgatttagcggatagtcggccttcgattctgcgaacgactggcatacactgcgcggccgttttttccaaccggaactcgaaagacatgaaaaacgcatctgcggcccgtgcctgcggtatcgacttcggcacgtccaactccacggtcggctggctgcgccccggcatggaaacgctgattgcgctggaagacgacaagatcaccctgccgtcggtggtcttcttcaacatcgaagaacgccgtccggtgtatggccgcctggcgctgcacgaatacctggaaggctacgaaggccggctgatgcgctcgctgaagagcctgctgggttccaagctgatcaagcacgacaccagcgtgctgggcacggcgatgccgttcaaggacctgctgggcctgttcatcggccagctcaagagccgcgccgaagccgccgccggtcgggagttcgaggaagtggtgctgggtcgtccggtatttttcgtcgatgacgacgccgccgccgaccaggaggcccaggacaccttggtggaagtggcgcgcaagctgggcttcaaggaagtctccttccagtacgagccgatcgccgcggccttcgactacgagtcgaccatcgagcgcgaagagctggtgctgatcgtcgacatcggcggtggtacttccgacttctccctggtgcgcctgtcgcccgagcgccgtggcctggacaaccgccacgaggacatcctcgccaccggcggcgtgcacatcggcgggaccgacttcgacaagcagttgagcctgcagggcctgatgccgctgttcggctacggcagccggatgaagagcggcgcctacatgcccaccagcacccacatgaacctggcgacctggcacaccatcaactcggtgtactcgcagaagtcccagctggccctgggcagcatgcgctacgacatcgaagacaccggcggcatcgaccgcctgttcaagctgatcgaacagcgcgccgggcactggctggccatggaggtggaagagagcaagatccagctgacccacgccgacaaccgcgtggtacccctggaccgtatcgaggccggcctgagcgtggacctgagccgggcgctgttcgagtcgtcgatcgacagcctgctggagcgcatccgcggcagcgtcacgcaactgctgggcgatgccaatgtcggcgtcggccaggtcgatacggtgttcttcaccggcggttccagcggcattccggccctgcgccagagcgtcgcggacatgctgcccaacgcgcgccacgtcgaaggcaacatcttcggcagcatcggcagcggcctggcgatcgaagcgaagaaacgctacggctaaaaaagcatcgcctgtagccgctaccgcaggctgcgataaggtccgccggaccttcagcgattttgagatcgctacggccttcggccgatcgcagcctgcggcagcggctacagggatagcgtcaggtcaaaccaatcccgcctgcttcaattcactcttcaggtaggcgtagtagatcggcccggccaccacccccggcaggccgaacgccgcctcgaacaccagcatcgccaacagcaactcccaggacttggcactgatctgtccgccgacgatccgcgcgttgaggaagtattccagcttgtggataaagatcaggtagcccagcgccgccgcggccacccagatcgacagcgacatgccgacgatggtgatcagggtgttggagatcaggttgccgatcaccggcaacagccccagcaggaaggtcagcacgatcagggtcttggtcagcggcagcttgaccccgaacatcggcaggatcagcgcgaggaagatcccggtgaagaaggtgttgagcagagaaatcttgatctgcgcgaacacaatgttgcgaaaggcctggaccagcaggtgcaggcggtcgaacagcgcggccgccagtggcttgcgcttggtcaggtcgggcacgcgctgcaaggcaatgatcgcccccagcaccatgccgatcagcaaggtcacgaacatgtgcgccgcgtccttgcccaccagttgcagctcgctcaagtgcttgctggcccaggcgccgatggccacttggaactccgccgcgctggccggcagataggagtcgaggaacggcggcaactggccgcgcgccttgtccaccaccgtcatgaatttgtccagggaagcccccgggttctccgcttcgtgcagcaggaagctgatggcgccggcgaacagcagcgtcagcacgctgaccaccagggtgccaagcagggccaccgccaaccagcgcgcccgccgaccttcgatcagccgttgcagttgcggggtgagcatgttgaccagttcgaacaccagcaggcccgccagcaggctcggtaatagccgcaacgggattaccagcaacaggccgccgaagatgatcacccaactgaacaacaacagatgacgctgagaaaacgttggcatacagcctcaaacaaacagcgtgaaaggattggcagtctgccagcgttgcactggcgatgcgaggccgacaggcgcgggtttgctggcgatcaacgatacagggtgtgtcaggcaaaccgccgcgaccggatcgtgaacaagctcgcgcctgcgaaggagaaggttattgcttcttcaggcacgtgctcatgaaggtcttgcgctcatcgcccttgagggctttggcagtggcgtcggcgttgcaggtcttcatccgttcctgcggggttgccgcggcagccggggtggctttcaggcaggtgctcataaaggctttgcgctcatcgcccttgagggctttcgcggtggcgtcggcgttgcaagtggtcatcttgttctgctgggcggtggcggcaaatccttgggaacagagcagcagaccaaccatcaacaaagggatacgcagcatcttcatggagttttctccttgttaccgcaccgacgggcgcggcctccagcgcagtgtagacaaaccctgttacaggttcacctgttctgtaggctggtgcgccggtactgctcgggggtgcaaccggcctggcgctggaacatcgcgataaatgccgaggcgctgctgtagcccatgtcgaacgccacttcctggacactgcgcgcgctgtccagcgcctcgatggacgccaggaagcgcaggcgctggcgccactcgccgaaactcatgcccagctcgcgcacgaattgccgggccagggtgcgttcgctgacgtggatctgccgcgcccaatcggccagcgcgcggttatcccccggggcggcctgcaacgcttccagcacaccgagcaaggccgggctgctggcatacggcaggtaaccgtcatgcaccggcgcctgttgcaactggtcgagcatcacctgggccaggcggctgtccgcttcctgctcggggatctgcacatcgcgcgcggcgaagtccttgaggatcgccttgagaatgtcgctgatggccagggtacaggcctgctgcggcagcgcctggcacaactccggggccaggcacacggcgcggtacacgatcggctgcgggctgtagaaactatgctcggtgcccggcggaatccagatggcgtactgcggcggcgacataaagcgctggccggcgatttccatgtgcatcacgccatgggccgaatattccaggcagccccaggggtggcgatgttccagcgcatggctgtgggcgtcgaaatcggcgtagcgaaagtacaccggcgccggcagaccgctgaagggcagcaggtcgatgtgttttttgctcatgctgtccggattcaggggcgggttgtctggatcgaagtataggcctggatccagacagagggataatcacccttcatcaacgttctggttttcctcatgcaatacgcttatccgttactggccgtctttatctgggccggcaataccgtcatcaacaaactggcggtcggggcgatcttccccgcggagatcggtttctatcgctggctgctggccggcctgttgttcacgcccttcatgctcaaggcagtggtcgcccattgggcggtgatccgcccgaacctgggcaagatcttcatcctcggcgtgctgggcatggcggtgtaccagagcctggcctacttcgccgcgaccctgacctcggccaccaacatgggcatcatcctctcgctgatgccgctgatgtcgctggccatggccatcgccagcctcggccagcgcctgacggccggcgccctggccggtgccgtgttgtcgtttgccggggtgctggtggtggtgtcgtccggcagcctcgaggtgctgctggaacagggggtgaacctgggcgacgcgatgatgctgatcgccaccctggcctacgcgatctacagcaccctgctgaaaaaatggcagctgcgcctgccgccgctggtgctgctgtacctgcaggtgctggtggccgtggtggtgctgttcccgctgtttttggcctcgccgaaaaccggcctgaccctgcacaacattcccctggtgctctatgcctgcctgctggcctcgatgctcgcgccgctggcctggatgcaggcggtggtacgcctgggaccgagccgcaccacactgttcttcaacctgctgccactgatcaccgcgctgatcgccgccgtggtgctgcatgaacagctggcgctgtatcacctggtgggtggggtgctgaccctgggcggggtgatcctgtcggaacgctggaccaccgcgctggggcgcaaagccagcgtcgcctgacagatcgttatcgcgagcaagctcgccagggaccgctcgatcctgtaagagcgaacttgctcgcgataaatctcaagaccgccacatccctctctggctatacccccgccgccttcaaccgctgcgcatgctcgacaaacagccggatcggctcggcgcccttgcccaccagccccagcgactggttgacgatatcgaagtggtccagggggtaatcgtcgccaatcaccgtgcccaggtgcgagctgtagcggccgaccatgccatcgcactgcccggcctcgcggacaaaggtcctggcgaacagccggcaggtgcggttggtgccgtcgaacaggttgcgcccgcgattggtcttgcccggctgcaaggtgccggaccaggagtagtagcgcaccccgttgacctcttccggcccctgcccgccccaggtgtccggcaggccctggggatactgccggttgaacagcgccacgccctcgctggtcagcgagcggtgcgaagcatggatatccgccggcagcttcggcccacgatagccggtgtcgagccaactcatcagcacggcaatcacccgcaggataaaactcagcacgcgcccgcgcagggtgtcgatggaatggtggcgttcgatgtagtcggccagctccgagccatgattgggcccggccaccgaagtcaccgaggccacccagtccgggcgtttggccgcggcatagcgggcggtgagcgagccctggctgtggccgatcaggttgaccttgtcggcgccggtttcgcggcggatctcctcgatccgcgccagcaattgctcgccgcgcacctcagtggagtgcagcggcgagacctgcacggcaatcaccgtggccccgccgcggcgcaacgccgactcgatgccgaaccagtaggagtacagcaccagccggataaaccccagcatgccggggaccaggaccaacgggtaacgcgtggcaagctcttgggacatgggaacatccttgtgatcggacttgtatcagggaccgcggcgcccgaggctggatgcagacagcagccaagagcatcgacagccaagatgacagcttcacgaccactgtatgacattccccgggctccatcccttctacttcaaccccaccaccccggccacgatcagccccaccgacagcagcttgaccagcgtcaggctctcccccagcaaggcgaaaccgaggaacaccgtgcccagggagccgatcgcggtccagatcgggtaggcgatgctcaccggcagttcacgcatcgccagggtcaggaaatagatgccacccagcgcggccaccaccgtcagcagcgacggccagagccgggtgaacccctcggcgtacttcatgcccatggcgaaggtgacttcgaaggcggcggcgatcagcaagaacagccaggccatgtcgcctcctcagaaggtccgcgccagtgccagcaggcgctgctcggcttcggcgcaggacacctggaacgtgcgctcggccgactcctcgccttcggccgcgaccaccgtgacgtcctcgatcccgataaagcccagcgcggtgcgcaaccatggatcggcatggttcatggcctccagttcgccgcccgggccgaagccgaagccgccgcgactggtgacgatcagcgctttcttgccccgcaccagcggctcgtactgggcgatgccgttgtcctggacggtattgaaggtcaggcccaggcgcacgatctggtcgacccaggccttgaggccgctgggcacgctgaagttgtacatcggcgccgagatcaccagcagctcatgttccagcaactccgtcaccagctcgtcactcagggccaggtcggcctgcatcgacaagggccgtgcctggggttcgggataaaacgccgcggcgacgaaggcctcgctgacatggggcagcgaggcacggccgacttcccgacgggtcaactggccctggggatgggcctcgagccaggcctggagaaaacgttccgtcagccgccgcgaatgggagcgttcgccacgggggctgccatgtactgctagaattctgctcatctgtcattcctcatcctggatcattctggaagaccgtaaaaagccttcctgggcgaggaataaagctattgatgcaggccccctggaacaaatgagcaatagttgatcaggatgaatcaatttcacccataaggtgacccagtatgtttgccaacctgccgctgaccgccctgcgcgccttcgaatcggcgtcccggctcctgagtttcaaggccgccgccgaggaactgtcggttacacccacggcgatttcccaccagatccgctctctggaaagctggctgggcgtgccgctgttccagcgcctgccgcgccaggtgcgcctgaccgaatgcggcgaacggctgttccacagcctgcacggcgccttgctggaagtggcgcagagcgtcgacagcctgcgcccgcaacgcagcggcgcgaacctgatgatctccaccacgccggccttcgccgcgctgtggctggtgccgcgcctggggcgtttttatgcccggcacccgaacatcaacctgcgcctggacaccaattgcgaggtcatcgacctgcagcaggatgccagcgtcgacctggtgatccgctacagcctggacgactacccgaatctctatgggctgtgcctgttcgacgagtgcttcgcggtctacggctcgccggagcaggtggtccaggcccgcgagcaaacgccgacgctgatcagcgtgcgctggcacaattccaagctttacgcccatggctgggaggcctggtgcgacaaggcgcaggaaagctggatgcagggccgtccggtgattcgtgaatacgacgaggaacactacgccctgcaggcggccattgccggccagggcctggtgctggccagcaatatcctggtgtcggaaagcgtggccagcggcctgctgctgccgtatcgcccggagatccatgtcgacggcgcgggctacagcgccttgtgcgtgcccgggcgcgaacggcatccgccggtgcgggcatttttccagtggctgcgcgaagaggcccaggcggccgggcatccgatgctcgccgccggctaatgccccagggaccaggcaggagcgagcttgctcacgaaaagatcgccaaggatgaccagttttggcagacaggtcgccgcttcgcggctatcgcgagcaagctcgctcctacaggaaaactccgtttgctctcaacgcgtcggtttgaccgccaccggcgccttgcccgaacgcatctgctcaagtagcggcgcacactggttcggctcgccgccgctcggcgccaccagcgccagcaacccggccgccggcccggcgatcacccccagcgccaccatgccggcgccgcgcaacatcagcggcacggcctcgaccccagcctccggcttgatgaacttgcctcgcacatagagcggcgagcgcagggagaacaggcgcaggcccttggattccggagtgatggtcaggtccagttgctcgctggccatgttcgcggtgccgtcgatgtagacgatcgcgttctcggtatcgaacacgaacaggcgagtggtggccaggccggtcttgatgccgaagtcggcggcggcgcaattgatcttcacttccttgtcgccaaacatcttgccgatcacatagttgccgacgttgagcccggcgatctccatcaggctgcggctgatggcgccgtcgttgatcagcatcttcagctcgccgttggcgctgccgagcagggccgccaccgagttgccgcgcccagcgatatcagcatcgccattgagttcgccgaagctggttttcatcggctcgaaggtcgggaacagctgcttgagcttgaagttgcgcgcggtcagcttggcccgaccttccagcggcgtggcctggccgttgaggcgaatctgcgcatccagcttgccgccggccacgccgaaacgcagcggctccaggctcaggcgcccgtcgtcgagcaccaggtgggtgtacaggtcggtgaagggcaaatcggcgctgtggacgatgcgcttgccggtgaactcgacatcggcgtccatgtcacgccagcgctcggtgcggaactcttccaccggcagcaccttgtccgccggctgcttgctgtcgccgccacgggccttctgctcggcgttggagtcggcgccgatcagcggcgccaggtcgctgaacagcaactgattggacaccagcgcaccagtcagcttgggccgcggctggctggcgacgtaggtcaggttgccgtgaatgtcgctgtcgccgatcttgccgttgaaatcctggtactggaacttcgccccggccggttcgcgcaactgcgcgctcaggtggccatcggtggcataggccggcgagtccggcagggtcacgccggtcagcggatacaggttgcccaggctggtgccggcgagcttcatgcgcagatccagcgcgccaaggttgagcgggtcggtcagggtgccggccagttcgacgcgggtatcgccgatcgttgcctggacttgcagcgggaacggcttgctcgcgtcctgcagcgccagcaagccgccgatcttgccggagccggtgagcgcctggccgtgatattgccccttggccttgaaggcaaaggcataggactggggagctgcgcctttctcctcggctttcttcgccgccttgtcgccgacgatgtcgctgaacggaatcggcttgcccaacgggtcgatcagcaggtcgaggcgggttttcaggctttggtcattgaggatgacatggcctttgtcgaagccgatggcgccgatgtccactacccagttggagggctcggcgttcgggtctttcgggtcgaactgaaaggtccagttggcgcggccgtcggccaggcgttcgagagcggcgttcggctcggtgaggtcgatacgcggaatgcgcacgcgctgcgccagcaatgccaggggcgaaatgcgcaactcgacgcgcttgaggctgaccatctgcggcgccttggaccagtcggggttgcccagggtcaggtcttcggccaccacatgcggccacggcacccaggcccgccagccgccttcgtcgggctcgcgctgccagatcaccgccaggttgccgttgatggcgaaggggcgatgcagttcttcggagactttggcattgagtggcggcttgatccggttccaatcgaagaacgcgatgatcagtaccagcacggccagcagcaggaaaaggctaccgactgtccaggcgagaattttacgagtgcgcgtcatgcacagggctcctgactactgaagggcgtcgggataacgacgcccctgtgaacggccggggttgaaatccaccggtcatgaaaactaggactgacaaacggcccgcaggtttaacccaaagccgcgaatcagacacaaaagcacggtttttcctgaccgaagcgccagcttggcgttaccgccgccgcacttttgcgaggcgcagatgggtcgaaaatacccaccccagtgcaaaacctttcttcggaaacgcccgttctagagccctcgggcagaacaatcaattctgttgattattaccattgtctttatgaacttttatatcgattttgcgcgcgtaacattggctccgtacccactttatcgccctcccaaggagcaacccatcatgaaacgccaattactgcttagcctgaccctctcgatcctggcagccaacgctttcgccctgccagccgctgaacaggctaccccacaagtcaaagccagcacctcggtattcacccagactctggcttccgacggtggcgaccgcactccacaaggccagaccctggcttccgacggcagcgaccgcaccccacaaggccaaaccctggcttccgatggcggcgaccgcaccccacaaggccagaccctggcttccgacggcagcgaccgcaccccacaaggccaaaccctggcttccgatggcagcgaccgcaccccacaaggccaaaccctggcttccgatggtggcgaccgtaccccacaaggtcagaccctggctgaagacggcttcgatcgcactcccctgggccaggctgtagccgaaggcggccgtgatcgcctggaagagaaaggtctggtttaagacggcaacgaccgtttggcctaatgcaacccagctgtgagtcaagcccatgatgcctctacagaaaagcccggtccctggatcgggctttgttttttcctgagccgcgccgtttttttctgcgtccaccgctccgatccaggtctcgccttcagctcaccgcccccaccaggttcgacgccggcaaagttgatttgctagagtgcgccgctctcttgatcagaaaaccagcccgccgatgctgccccgcgccgaacagaaacaacagactcgcaacgctctgatggacgctgcccgccacctgatggaatgcggccgcggattcggcagcctgagcctgcgcgaagtggcgaaaaccgccggcatagtgccgaccggtttctaccggcatttcgacgatatggaccaactcggcctggtactggtcagcgaagtcggccagaccttccgcgaaaccatccgcctggtgcgccataacgaatttgtcatgggcggcatcatcgatgcctcggtgcggatcttcctcgatgtagtggcagccaaccgctcgcagttcctgttcctcgcccgcgagcagtacggcggttcgctgccggtgcgccaggcgatcgccagcctgcgggaaaacatcagcgctgacctggcggccgacctgaccctgatgcccaagctgcaacacctgaacatcgccgacctgacggtgatggccgacctgatcgtcaaaagtgtgttcgccaccttgccggacatcatcgacccgcccgcgcaagccctgcccgagcaccttacgccgcaggcgaaaatcacccagcagctgcgtttcatctttatcggcctcaagcactggcaagggctgggcagcaccgaataaccccccgccgctgcgctcaaccgcaccacctcctccaccgcctcatctgtccgccatggctcgcgccagagcggcgcttcgccgcgcatcaaaaaacagcacaacgcaccaagtcagtgctataaatcagcgcgcgccatgaatttgtaacaaaataaaacataggactgccccattttcaggcgctttccacccgtttccgatcagaccgggcgattggcaaggcacttgctctacaccctgcatcgctcatagctggaagccttccaatgctggtgattcatcgcagaatcgcgccgcaacccgactggtccgccgagttgcacctgaccttcgaagcccgcagcaaaagccgtttgcgctgttttagtgccgacggcgaggacgtcgggctgtttctggagcgtggccagccgccgctgcacgacggcgaatgcctgcaagccgaagacggccggatcgtgcgagtctgcgcgcgtccggaaaccctgttgcatgtcacctgccgcaatgccttcgaactgacccgcgccgcctaccacctgggcaaccgccacgtcgcgctgcaagtcggcgatggctggctgcgcctgctcgacgactatgtgctcaaggccatgctcgaacagctcggcgccaataccgaaaccatcgaggcgccgttccagccggaacacggcgcctacggcggtggccatcatcattcccgccacggcgacgaggacttcaactacgcgccgcggctgcaccagtttggcgtgcgcccatgaacccggcctgggccctgctgcgcctggccagcccacagctgccgattggcggctacagctattcccagggcctggaaatggccgtggaacaggccacggtcaacgatccgcacagcgcccgacgctggatcggcgaccagttgctgctcaacctcgcgcgcttcgaagcaccgctgttgctggcccattgtcaggcggccgcggacgaggactgggcgcaattgctgcagctgtgccaggaacatcgcgccagccgcgaaacccgcgagctgcatcaggaaagccggcaaatgggctattccctgcaacagctgctgaacggcctgccggagctggatccgccggcccacgcctttctcgcgcagatcgccgagccgcatctggccctgggctgggccctggccgcgcgggcctggcggatcagcccgcaggacgccctggccgcctggctgtggagctggctggaaaaccagctggcggtgctgatgaaaaccctgccactgggccagcaggccgcccaacgcctgaccagcgaactgctgccgctgttgcaacaggcccagcgcaatgcctcgaacctcgcccccggacattacggcagcgccgccttcggcctgtccctggcgtgcatggcccatgagcgccagtacagccgcctgttccgttcataagtccttttacttcggcgccttttacttgggtgtcttttactttggagagtcacatgaacgcacaacctctgcgtgtcggcatcggcggcccggtgggctccggcaagaccgccctgaccctggccctgtgcctggccctgcgcgaacgctacaacctggcggtggtgaccaacgatatctacacccgcgaagacgccgatttcctggtgcgcaaccaggctctggcgcccgagcgcatcatcggcgtggaaaccggcggctgcccacacacggcgattcgcgaagacgcctcgatcaacctcgaggcggtggatcagctgaaccggcgttttcccggcctcgacctgattctggtggagtccggcggcgataacctgtcggcgaccttcagccccgagctgtccgacctgaccatctacgtgatcgacgtgtcggcgggcgacaagctgccgcgcaagggtggcccgggcatctgcaagtccgacctgctggtgatcaacaagatcgacctggcgcccctggtcggcgcttcgctggagatgatggacagcgatacccagcgcatgcgcggtggcaagccgttcgtcttcagcaatcagaagaccggccagggcctggaggaaatcatcgcctttatcgaacgccagggactgctgatcgcggcctgatcgctcttttcaaaaagctcaacaaggaagcctgtccatgacactcaaacgcattctcggcaccctcgccctgctgctgaccccagctttggccttcgctcacccgggtcacggcgacaacggcctgatggccggcatcagccacccgatcggtggcctcgaccacttgctggcgatggttgcggtcggcctgtgggccgcgcagcagcaaggcgcggcgcgctgggcactgccctgcaccttcgtcggcaccatgctaatcggtggcgtgctgggttttgcagggctgaacctgccggccctggaaagcgggatcgccgcctcggtcctggccctcggcctggccgtggccctggcggtgcgtccgccgttgagcctcgcggtggccgccaccgcgctgttcgccctgttccacggcgtggcccacggcctggaactgccggacatgtccagcccctggacctatgccgcaggcttcgtcgctgccaccgcggcactgcacgctgccggttacgccgtggtccgggtcctgccacaggccgctgcgccgctggtgcgcctggcgggcgcggcgtccgccgcgactggcgtgtggttgctggccggctgatgcacgtcgtttgaggctttttttcgcgagcaagctcgctcctataggaacaacgccgccactgtaggaacgagcttgctcgcgattaagggctccggcccaaccactatccccagggccttctctgctaccatgtcgcgcattccaccctgccgtgacgacgccagccaatgcccgatgtttccagccccacttccccgtctgaatcgaccgccctgtttacggccgtgcaacagcatttccacagcgtgatcgtgccgctctggcaggggccgggctggaatccggaactggcgctgcccttcgaggcgctggacgccgagcatgccccgctgccacctcagcgttatcgggccatggcctgcgcccggcagctgtacctgttttccagcctgatcggcgatggccgtacgccgcttgccgaagagcgcgccgcggcgctgttccgttccctgcaacggcacttccacgacgccgagcacggtggctggttctacagcatcgatgcccagggcgcgccgctggacaggcgcaaggacctctacacccacgcctttatcgtctttgcctgcgcccattactgggccagggtccgcgagccgctggtggaatcggtgctcaatgccgcgctgaaagtggtggccgaacgttttgccagcggcgatggcttgtacgaagcggtcctcgccgaggactggtcgtccctggcctccggtcccttgcagaacccgctgatgcacctggccgaagccttcctcgccaccctggccgtgcgtgacgacaccgccgtgcaaagcgcgctgcaagccctgtgcacatccatgcagcagcgcttcatcgagccacggcatgggctgatgatggagaaaccgctgggggctgtggataactggttcgagccggggcaccagttcgagtggttcttcctgctgcaatcctcggccttgctgcgtggctgcccgctgcacgcctcgctggagcgggccttcgcctatgccgagcaggttggcgtggataactccagcggcgcggtgagcgggatgctgagcatcgatggcgatgtgctcgacccgacccagcgcatctgggcccaggccgaatacctgcgcgccctgaccttgcgccaggacagcgccgaacgcctgcagcaccagttgctggcgctgcaacaacacttcctgcatgccaagggctggaacgaatgcctggacgcccatggcgtactcagccgccgggacatgccgtcgaccacgccttatcacctggcgacctgttatctcggcctggctgaatacttcggctgatctttacatcgcgattgcgcgcctgcgctcaggaaggcctcaggcaatccacttgcgatcgccggtaaagctgatggtcagccagcgcgccgcatccgccttgccgagctgtgtggatatctcctcgcgcagcttgtccagcgtcgccacgccctgcaatggatagtcctgcggcagcacgatgtgaatctcgataaaccgcgcccgtccgtgcttctgcacatacgagacatagtcggcaaagccgtgttcgactttcgcctcgtccatcacttggcgaaccttgtcatccagttggtccgggacaatccccagtacatcgcgtaacgctggcttgagaatattgaaagccggcgcgagcatgctcagggccagcaggatcaggatcgacgggtcgacgtaagcggcccactggccataaccctgggtcttgagcagcaacgcgatgagaaagctcaccagcaagccgaccgagagcatcgcgtccaccagccagctgatgttgtcgaactggatcaacgaggatttcaacgtgcgattgcgataacggacgtagaagaaataggcgaagcagacgacgctaagcaccatcgcaaaagggatcaccaggcccagttcgatctcgcggccaccgttgatgatgccgaacataccgctgagaaaggcgtagatcgcaatcagcaacaaaaagctgccttcgatcaacagcaccatcggttccaggtgccagaagccgaactgaaagcgctggttactttccttggcgatcagcttggcggtgatcagcatcaagaccttgatgacggtcgcgatcagcgaaaagaaaccatcgaacagaatcgattgggaaccggaaaaaaaccccgtgacgatagcggcgatcgccacggcgaacatcaggacggtcgattgtttgagcagtacctgctcacctcggttactcacatttcctcctcgagaacctttgaattcgcggccttgatgcaaggctgcggtgggttgcggagcgggagtctaccttgtgcgggctgattcaggcctgaacggctgtgttgccaaacgcatcggcacgcggagtgtagccgctgccgcaggctgcgatggtccgggccacgttggtcgcaggaccttcagcgatcttgagatcctgcgaccggtttccggtcgatcgcagcctacggcagcggctacaggtggagcattcagcctttggcgttgcgctcgatggcgaaaccggcccaggtctggctcaccggcatcagctccaggctgttgatattgacgtgggccggggtgttgagcacccagaagatggtgtcggcgatgtcctgcggctggatcggctcggcaccggcgtaggtagcgttgtaacgctcctggtcgcctttgaagcgcaccagggagaactcgctttcgcacaggcccggctcgatgttggtcacccgcacaccggtgccttgcaggtcgcaacgcaggttcagggagaactgtttgacgaacgccttgctcgcgccatacacgtggctgcccggatacgggtagttaccggcgatggagccgaggttgacgatgccggcgccgcggccatgggcgatcagccgtggcagcagcaggagggtgctgtacatcaggcccttgatgttggtgtcgaccatggtgtcccagtcgtccaggtcgcacttgggcgccgggtcgacccccagggccaggccggcgttgttgatcagcccacgcagcttggcgaaggacggcggcaggttggcgatcgcttcttccatggccttgcggtcccgcacatcgagcaccaggccgtgcacctcggtctgcttcgacagctcggcgcacagggcgttgagacgctcttcgcggcgaccggtcagcaccagcgaccagccggcctcggcaaaacgacgggcacaggcttcgccaaaaccggaggttgcgccggtaataaacagggtggaagtcatggtgttctccttgctgggcgtcgaaccgccgtggaaatgaaaaatcgtttcgcagcatgcccggcctgaatcgcagcggcaaccggaggttgtgcgagccaggctatcagcctcccctgtagccgctgccgaagactgcgatcggtctgggcggcattccgttcgaagagggcgtgctcttcaagatcgttgaaaggccctccgggccttatcgcagccttcggcagcggctacagagacgcaactgtacaaaaaacaaccaaccaccgccaagccaggaaaatcgtggcccgcagccacatgcacgcaccttatccacaggacgctccacagtctttgggggcaagtgcaaaagtccgtaagccgctatccacaggggctgcaggcggttttagaaagttttttgcttgacctgggcatggcgtccatgcagccccggccgacacagcagaccggacggtcaggcaagggatggcttcaagccagtaacgacgctgcctcggcgagtctttccagagtttaatcacagacttatccacaggtttatccagggggtttccgcccttttcctgcgacaataaaaaggttgacaacggccgctcaaggtccggcaaaaacgcctgatcaaaaaacgatcgccagcctgcaggccacgccactcaaggcgtccagccagctactcccacgttacccacagccagttccacagcaaacggggacaagtcaaaaccgtggcaaaacaactatttgcagcgtctttatgccgcgctttgccagcttgcgcagaatgttttccacaatttgcgttttctgctgtgggcaaggtcatccagcctctgtaggagcgagcttgctcgcgaagaacccgagaacgacgcgtatatccagacagccagcgtcaccgttgacgagcatcgcgagcaagctcgctcctacaagatcaaggggataaaaaatgccccggcggcgcgaaccggcggggcatgtcttatccacggtactcaggctcagtgaccgcccagatacgcgttacgcacctcctcgttgaccagcagttcctggccggtaccgctcaggcggatctcgccgttgaccatcacataggcgcggtccgacagcttcagcgcgtggttggcgttctgctcgaccaggaagatggtcatgccggtggaggccagctcgcgcagggtggcgaagatctgcttcaccacgatcggcgccagccccaggctcggttcgtccagcaacagcagcttgggacggctcatcagcgcgcgggcgatggcgagcatctgctgctcgccgccggacatggtcatggcccgctgggttcgacgttccttgagccgcgggaacagttcgaacatgcgctgcatgtcttcgctggcgtacttgtcgccgatggggatggtgcccatcagcaggttctcttccaccgtcatgtccggaaacacccggcgcccttccggcgactgggcgataccgttggaggcgatgtagtgcgaggacttgtgggtgatgtccacaccgcgatagatgatctgcccggactcggcccgcggctggccgaaaatcgacatcagcagcgtggacttgccggcaccgttggagccgatcaggctcacggtttcaccttcgttgatgtgcagcgagactttcttcagggcctggatcggcccgtagtacacgtccaggtccttgagttcgaggataggcgcagtcgtcataccagttcctcttcgtccgcacccaggtaggcggcaatcactttcgggtcgttgcggatcgcttcgggcccgccctcggcgatcacgttgccgtggtcgagcaccacgatatggtcggaaatactcatcaccatgcccatgtcatgttcgatcagcaccacggtcaggtcgtgctcgtcgcgcagcagccggatcatcgcgctgagcgcttcggtttcctgggggttgaggccagcggccggttcgtcgaggcagatgatctgcggccgggtgcacatggcgcgggcgatttccaggcggcgttgctggccgtaggacaactcgccggccaggcggttggcgcagtccaccaggtccaccacctccagccagtagaaggcgtggtccagggcgtcgctttcagccttctggtaacccttggtgttgaggatgccggacaccaggttgcggttgacccacatgtgctgggccaccagcaggttctccagcaccgacatttccctgaacaggcgaatgttctggaaggtccgcgccaggcccgcccggttcaccagatgggtaccaccgaacatcttgtagaacagccggctggcaaagcgcctgggcgacacgaagtcggtcgcgcgaaacggctcgcccagcagcttgatgacgttggtcggcttgcctcgggtattgagggcgatgtgcccgcccgtggccttgtagaaaccggtcaggcagttgaacaccgtggtcttgccggcgccgttggggccgatcagggcgaagatggagttgcgtttgacctccaggctgacgtcgcttagggccttgatgccaccgaagtgcatcatcaggttctctaccttgagaatgacttcatcgctcatggcacgctcctctcgaccaaggcacctttacgcggggttaccccggtacggctgatacgaatcaggcctcgcggccgccagatcatcattaacaccatgagaatgccgaacagcagcacccggtactcggagaagctgcgcagcagctccggcgccacggtgaggacgaacgccgcgatcaccacgcccacggtcgaccccatgccgcccaggaccacgatggccaggatcagcgccgactcgaagaaggtgaaggacgagggattcacaaagccctggtagctggcgaagaacaccccggccaggcccgcggtggaggcaccgatggtgaaggccgagagtttcaccagcacgtggttcaggcccatggcgcggcaggcgatctcgtcttcacgcagcgcttcccaggcccggccgaccggcatgcgggtcaggcgatgcttgatgtagagcaccagcagcaccacgatgaacagcacgatgtagatgaacaggaacttcaggttggggttgtattccaggccgaagaactcgtggaacggcaccccgccatccttcgcccgccgagtgaattccaggccgaaaatgctcggcgacggaaccggcatgccgttcgggccgccggtgaaggacagccaattgttgagaaccaggcggatgatctcgccgaagcccagggtcacgatggccaggtagtcaccgtgcatgcgcaacaccgggaagccgagtatgcatcccgccagcgccgcggcgagggccgccaggggcagcacggtccagaagcccaggccgaggtactggtagcccagcgccaggccgtaggcaccgatggcgtagaacgccacgtaccccaggtcgagcagcccggccaggccgaccacgatgttcagccccaggccgagcagcacgtagatcaggccgaggatgaccacggtcagcaggtacttgttggcgaagaacgggaagacgatggcgatcacgatcagcgccgggatgatccagcgcagccgcgacttgtagtccggcgccagcacatgcacaccggaaccggtgctttcgaaaccctggaggatcttcaaccccttgggcgtctgcaggaacaggctcaaggcgaaacggccgatcatcacgatcgccaccagccagccgacgcgggccggttgcaggttgaagctgtagccctcgagtaccacgcccacgataggaccgaacacgatcagcgagatcagcccggccagtacggcgtcgatgaggctctttttgatatcaatcggtttattggcagcagacatacttataccttcgccacgagtgggcgacccagcaggccttggggacggaagatcagaatcagcaccagcagcgagaaactgaacacgtctttgtagtcggagttgatcagaccggagaacagcgactcggagatcccgaggatgatcccgccgagcatcgcgcccggcagcgagccgatgccgccgagtaccgccgcggtgaacgccttgatgccgatgatgaagccggcatagaagtcgaacgtgccgtagttcatggtgatcagtacgcccgccagcgccgccatggcggcgccgatgatgaacacgtaggaaatcacccggtcggtgttgatcccgaggatcgaggccatcttgcggtcttgctgggtggcgcggcacatgcggccgagcttggtgtacttgatgatgtaggtgagcaccgccatgccggcgaatgccgccaccaggatgaagatcttggtgtaggtgagctggacgaaaccggtgccgatgtcgaccttccaggcgccggccagcagcgtcggtacaccttgttgcttggcgccctggctgatctgcgcgtagttctgcaggatcagcgagataccgatggcgctgatcagcggcgccaggcgggtggagttacgcaggggtttgtaggcgacgcgctcgatgacccagccatagatccccgtcacgacgacggtgaagaccagggtgccgagaatgagtagcgggaaggattcgatgccgaagtaggccagcagagccagactgattgccgcgaggtaagcggaaatcatgtaaacctcgccgtgggcgaagttgatcatgccgatgatgccatagaccattgtgtagccgatggcgatcagaccatagacggacccgagggtcagtccattgatcagttgctgcaggaaaataccatccataacgcaatctcacgcatttgagagactgcacacagcggatacgacggcctggggttcaaccacccgcgcaacacgacagttgtgcagctctacgagaaaagacaggtactgcacggacacgcatgcagcaggcctgcgccctcccctggaggaagggccggcctgcccagacgctcatgtcacttctgtttttccagctggtggtatttgccgtccttgtcccactggtaaaccacgtagtcggagactttcaggtcgcccttggcatcccaggtcttctcgcccatcacggttttcaccgggttggccttgagccacttggcggcgtcctcgcccttgttggacttggccccgccgaagccggcagccagtgcctggaccgaggcgtaggcgtacagggtgtagccttcaggctcggtgccggccttgcggaaagcgtcgaccacggtcttgctgtccggcagcaggcgcgggtcggcgccgaaggtcatatacacgccatcgacgtattgcggaccgccagcggtggtcaccagttcgtcggtaacgataccgtcgtcggacatgaacttgacgtctttgaggccctgctcgcgcatctggcgtaccagcggaccggcttccgggtgcaggccgccgaagtagacgacatcggcaccggcggcgcggatcttggtgaccacggcgctgaagtctttctcgccgcgggtcaggccttcgtacagcacgggcgtcacgccgcgcttgctcaactgggccttggtggcatccgccaggccctggccgtaggtgtccttgtcgtgcaggaccacgactttcttgcccttgagcacgtcgacgatgtagtcgccggcgacgatgccctgctggtcgtcacgcccgcacatgcggaacatggcggagaggccgcgctcggtgacctgtgggttggtagagcccggggtgatggcgatcacgcccgcatcgctgtaaacctcggaagccggaatggtcgacgacgagcagaagtgaccgaccacaccggccaccttgtcctggtccaccaggcggttggccacggccacggcctgcttcggttcgcaggcatcatcgcccttgaccaggacgatcttctcgccgttgacgccgcccttggcgttgatctcgtcagccgctgcctgtgcacccttcatgtactgctcgccaaatgccgcgttggcgcctgtcatgggacccgctacgccgatcttgaggtcggcctgagcaaacgcagaaacacccaacgcagctgccactgcgagggccagaaagcctttcttgtaaaacgtctgggacatgaggtggtgctccaaggtttttttagttggcactgcgacttcaccgaatgctcagagcaagggccgtgccattggttttttattctgaaaaaagtcgctcttttattgttatttcgactgtttcgagcccttttttatggggcgtgcaaccgtctaaaccgcggaaggtgaaaccttacaaaacaacaggcgcaacccgcctgcgccatcattgcaaccgcgacgcaaatcaacgtgcaaccagcctgtaacagcctgcgtaaccgaactgcacactactggtgcaggactgctacgccccgcaccactacaggctagtcgctgcgccgaaaagcgccgcacccggcaacatatttcctttgtcagataacgatccgcaggcactggcccgcgtgatacagggagaacccggcctcgtacaggcaactgcgcaagcccacgccggccaggggctgcatgggggcgaagggaatcggcaaggcctgaggatttccgttacacaggtaatcggcgaacgccttgccgaccacggtgccggtggtcacgccccggccgttgtagccggtgaccgccaccagaccgggcgccggctcgaacagacgcatcaggtgatcgggggtaaaggcgatgcaaccggtccaggtgcactcccactccaccgttttcaggtaagggaaatagtgctgttgtacccggtcggcccaggccttgaggaaccaggccggcttctggttgccattgcccaggctgcccagcaacaggcggccgtcggcatcccggcgaatgctgctgagcacctggcgggtatcccaggaaccctggccacccggcaggatccgctgtgcggcttcctcggtcagcggcctggaggcgacctgatagtagtaaccggggaaaaaattgcgccgcaattcggtccagtcgccctcggtgtaggcattggaggcaatcaccacctgctcggccagcaccgagccctgggcggtctgcaccgaccagcgctggccctggcgttcgagacgggtcaccggcgaatggtcgaacagttggccacccaggtcgaccgcggccttggccaggccactgacataggccatcggattgaccgtgccggcccgacgatcgagcaaggcggcggcgatcttcctggtgccggtggcggtttcacaggccgcgccggtcaacagctcgaccggcgcaccccggcgtttccactgggcttcccggctgcgcaggtcggcctcgccccgggcgttgtgcgccatgtgcaaggtgccttcgcggcgcagttggcaatcgatgcggtatttgtcgatcaggctgaacaccagggccggcgccgcccccagcatgcggttgagctggctgccgaccgcctcgccgaaaccggcctcgatctcgtccggcgggatccacatcccggcattcaccagccccacgttgcgtcccgaaccaccgtgaccggtgcggtgggcttccagtacacaaacccttttgccctgctccagcaggtgcacggcggccgacaggccggtaaaacccgcgccgatcacgcagacatccaccgtgacctcgcccttgagcggggcattgtcaggcctttgcggcgtcagtttttcccacaggcattcttcgcgtaacgacataggagctccttgcggagcagcggtcagctacaagctgcaagcttcaagcggcaagctgcaagcgaactcacttgcggcttgcagcttgtggcttgcggcttacagcttgccgctgctactcaaaactgatgccttgggccaatggcaactccagcgagtagttcacggtgttggtctgccggcgcatataggcgcgccaggcatcggaaccggactcgcggccgccgccggtttctttctcgccaccgaacgcaccgccgatttccgcgccgctggggccgatgttgacgttggcgatgccgcagtcgctgcccaccgccgacatgaactgctcggcctcacgcacatcggtggtgaagatgcaggacgacaggccttgcggcacggcattgttcaggcgcagcgcttcggcgaaatcgctgtagcccaccacgtagagaatcggcgcgaaggtctcgctgcataccacgtcgctctgctccggcatctcgacgatcgcgggcgacacgtaataagcgttggggaactggtcttccagctggcgcttgccgccgaacacccggccgccctcgctcagggcctgctccagcgcatcctgcatgttgtcgaagctgtgcttgtcgatcagcgggccgaccaggttgccttgcagcggatggccgatgcgcaccttggaataggcggccttgagccgggtgacgatttcatccttcaccgattcatgggcaatcagacggcgcaatgtcgtgcagcgctggccggcagtaccgacggcgctgaacaggatggcgcgcaccgccatgtccagatcggcgctcggccccaggatcatcgcgttgttgccgcccagttcgaggatgctgcgggcgaaacgcgcagcgactttcggcgccacttcgcggcccatgcgggtgctgccggtggcgctgatcagggccacgcgcgggtcgtccaccagcgcttcgccggcgtcgcgcccaccgatgatcacctggctcaggtactcgggggcatcgctgaagttcttcagcacgcgttcgaacagcgcctggcaggccagggcggtcaacggggtcttttccgagggtttccagatcaccgggttgccgcagaccagcgccagggtggtgttccaggcccagaccgcgacagggaagttgaacgcactgatcaccccgacgatgcccagcgggtgccaggtttcgcgcatgtggtggcccgggcgctcggaggcgatggtcaggccgtacagctggcgcgacaggccgaccgcgaagtcgcagatgtcgatcatttcctgcacttcgcccaggccttcctgggtgatcttgccggcttcccaggacaccagctcaccgaggtcggccttgtattcgcgcagcacttcgccgaactggcgcaccagctcaccacgacgcggcgccggcaccttgcgccacagctcgaaggcatgctccgcgcgacagacctgctgctccacctcggccgcgccctgccagttcaccgaggcgatgcggctgccgtcgatcggcgaatgcacgggctgcttgcccgattgatacagggccgggttcacaccaagacgatcaagcaatgcggcaaccatgggtcactccttacaaatggaaagcaaaaagtcgtagccgttgacacagctattcaggactgtagttgtagccggcccgagacttgccaacaaacgacgattaggcgagatatcattccgtttattcatgctgcgcagccgggacaagaacaaggaaccctcgatgctgaacaaacgctacctgccctcgatcaccgccctgcagtgtttcgaggccgtcacccggcacctgagcttcacccgcgccgccgaggagctaaacctgacccagagcgcggtcagcaagcaggtcgcgcagctggaagagctcctgcagcacctgctgtttcgccgggtacgtcggcgcctgcaattgaccccggccggcgacctgtacctggtggaggtgcgcaagatcctctcgcagatcgagatgtcgacccattacctgcgctcctacggcggcgaaaccgaagtcctgcgggtgtccaccccatcgaccttcggcgcgcgctggctggtaccgcgcctcaagggctggcgcctgcgccacccgcagatccacctggacctgtgcaacgagcaggaagccgacgacctgctgcagggccgcagcgacatggcgttctacttcggccaaggttcgcgccccggcaccgagtgcctgaagctgttcggcgaagagctggtggcggtctgcgcccccggcagcctgccgcagaagccgttcaccgacccgacgcagctggccgagctggtgctgctgcaactggcctcgcggccgcaggcctggcatgactggttcgacagccagggttaccacaccgagcacagctatcacggcccacgcttcgaaaccttctacatgtgcatccgggccgcccaggtcggctgcggcgtggccctgctgccgcggttcctggtggaagaagagctggccgagggcaagctggtgctggcctgggactacgccatgcccagccacgatgcctattacctggcctaccccgaacatgcggccgaagtgcccaaggtgcgggacttcgtacgctggatgctggaacagatcgacagcccgacgccggcctgatccgggatggaggccagacgaatggacgccatcgcgagcaagctcgctcctacaagagcagcgccgtatctgtaggaacgagcttgcccgcgatgaggccatcagcctcgacatcgtcccccagcaaaaaacgctggcaaaacccacggcggatatgcgccactactgccttcattgaacaagctggaaagccgcgtccttcatcgcggccagcatggagattcccgttatgagcgagagtgtgtttgccgatcgcatcgtgcagaacctgctcgacaccgacttctacaaactgaccatgatgcaggcggtgctgcacaattaccccaatgtggaagtcgaatgggaattccgctgccgcaacagcgaggacctgcgcccctacctggcggagatccgctaccagttcgagcgcctggccgacctgagcctgagcgccgaccagttgagctttctggagcgcatcagcttcctgaaaccggacttcctgcgctttctcgggctgttccgcttcaacctgcgttatgtgcataccggtatcgagaacggcgagctgttcatccgcctgcgtgggccctggctgcacgtgatcctgttcgaagtgccgatgctggcgatcgtcagtgaggtgcgtaaccgctatcgctaccgcgaagtcgtcctggaacaggcccgcgaacagctgtatcgcaagttcgactggctgagcgccaacgccagcgccgatgaactgtcacacctgcaggtggccgacttcggcacccgccggcgcttctcgtaccgggtccaggaagaagtggtgaacgtgctcaagcacgacttccccgggcgtttcgtcggcaccagcaacgtgcacctgtcccgcgaactggacatgaaacccctgggcaccatggcccatgagtggatcatggcccaccagcaactggggccacggttgatcgacagccagatcgccgccctcgactgctgggtccgcgagtaccgcggcctgctggggatcgccctgaccgactgcatcaccaccgacgccttcctcaacgatttcgatctgtatttcgccaagctgttcgacggtttgcgccacgactcgggcgatccgatcgtctgggcggaaaaagccatcgcccattacctgaaactgggcatcgagccgatgagcaagaccctggtgttctccgacagtctgacgctgcccaagtccctggagatttttcgcgcgctgcgtggtcggatcaatgtcagcttcggtatcggcaccaacctgacgtgcgatattcccggtgtcgagccgatgagcatcgtgcttaaaatggccgcctgcaatggccagcccgtcgccaagatctccgacgaagcgggcaagacccattgcaaggatcccaacttcgtcgcttatctgcgccacgttttccaagtacctgccgccctttctggcacatcaagcaaggagtgaatcatgcaagccgtacagcgtgaaattgctgaacagctcaaggtccaaccgcctttcaaggaccaggccgctctcgaggcagaagtcgcccggcgggtcgcgttcatccagcaatgcctgctcaattccgggctcaagaccctggtgctgggcatcagcggtggcgtcgactccctgaccgcgggcctgctggcccagcgggcggtgcgcgaactgcgcgccagcagcggcgaccagggttatcgtttcatcgccgtgcgcctgccgtacgacgtgcagttcgacgaacacgatgcccaggcctcggtggacttcatcgaacccgacgagcgccacaccgtgaatatcgggccggcggtcaagtccctggccaatgaagtggcggccttcgaaggccatcaggcggtaacccgggacttcgtccttggcaacaccaaggcacgcatgcgcatggtcgcgcagtacaccatcgccggcgccgcccatggcctggtgatcggcacagaccacgccgccgaagcggtgatgggtttcttcaccaagttcggcgacggcgcctgcgacctggccccgctgagcgggctggtgaaaaaccaggtgcgggccattgcccggcatttcggcgcgccggagtcgctggtggagaagatccctaccgccgacctggaagacctgtctcccggcaagccggacgaagcctcccatggcgtgacctacgccgagatcgatgccttcctccacgaccagccggtgcgcgaagaggcgttcaagatcatctgcaacacctacaacaagacccatcacaaacgcgtgatgccgttcgcgccataaataaacagccgtagccgctgccgagcccgcgaggctgcgtacgaggacgcagtcctcgcaaaacctgccctcgcggtccatgggacgtatgcggcgcctgattttgcgaccgctctgcggccgtacgcagcctcgcaggctcggcagcggctacaagatgcgcgcacaaaaaacgccgtgttcttttcaagagaacacggcgttttttttgtggcggtctggcgccccgccggggcgccttctcagcaatgccggatcacttcagtaccacggcgcctttcatcatcgagttgtggcccgggaacgagcagaagaactcgtagctttcacctgcggtcagcttcgacacgtcgaaggtcaccgagtctttttcgccggcaccgatgatcttggtatgggcgataacgcggctgtcgtctggtttcaggtagtccttgtcgatgccggcagccatgccgtcggtcgcgatgccggccatgtccgcgcttttgctcagcacccagttatggcccatgacgttcttcggcaggctgccggagtgggtcaggttcacggtgaaggtcttgcagctcttgtcgatggtgatttccttcgtgttgaaggacatctggtcggtggagtcgacatcgaccttgcattcggcggccatcagctggctgctggccagtgtcaacagggataccgcaacgagtttggcaaacatggtgaatctccaaggcagggttaacaaaatccatctgaatccatgaaggtgaagactgcctgagtttttcacaagttcctatgatttacatcaagaaattgtatacaactttgcgctatcggcctgatcgaaagaatcaaacagccagccatcggccccgggcctatgctcggcgcacatccctatcggagtgtccgccatgcacctcaacagcctgttccgcagcctgctcgccgcctacgcctgtggcgccagcggtacctatgaaagcccccgccgcgaggattgacccttggagcgcggccggccagccattactctgtggccctcatcgaccatggagtaaggcatgtctttagcgtctgtatgtgtgttctgcggtgccagcaccggcaccgacccggcctaccgcgaggccgccgaggccctcgggcgccagttggccgaacgcaagctgaccctggtctatggcggtggcgccgtcggcctgatgggcatagtcgccgacgcggccctggcggccggtggcgaagtcatcggcatcattccccagagcctcaaggacaaggaaatcggccatccgggcctgacgcgcctggaggtggtcgacggcatgcacgcccgcaaggcacgcatggccgaactgagcgatgcctttatcgcgctgccgggtggcctgggcaccctggaagaattgttcgaggtctggacctggggccaactgggctatcacgccaagcccctgggattgctggaggtgaatggcttctacgagaaactcaccggttttctcgatcacatcgtcggcgaaggcttcgttcgcgccccgcaccgtgacatgctgcaagtgagcgattcgccgcgcaaactgctggaggcgctggaggcctggcaacccacggtcgcccccaaatgggccgagcagaaacccgattaaccgccggcccccgatacaaggcagaatacgcgccgctcaacctcaccttcgaccccagaggatcgcccatggctaaacccaattactccttcgccaaacgtcagcgagacctggcaaaggagcagaagaaagaggaaaagctgcaacgcaagaaagcggccgctgaagaagccggcgcaccaagcccggatacagaagacgaagtggccgtcgacgacgccaatgcagtagacgatcaggcccccaaggcctgagacccgccaggcctgatactcctgtcaggccctcgggatctggggtcggctatccattaccgaccctcggatacccaacgctttgacaatcaaatcgcgataaccctgtggcaggttggccggtagctggtccggcgcgaacaggccctcgggggattgcagcacgcccttgatcgataccgggaacataagcgactcctgtaaagcccgtagccgctgccgaaggctgcgataaggttcaaagagccttcctgtggccgcaaaagcacggccgctacgcgcccgagcgcagcctgcggcagcggctacagagagatccgttcattcagtggcatcaccgtcacccgcacttccgggtcgtggctgccgccgccgagaatcaccccgcgcaatggcgagacatcggaaaaatcccggccccaggccagggtgatgtgctccagtgccggctgcacgttgttggtcgggtcgaaatccacccagccgagcaccgggcagaacaccgaaacccaggcatgggaagcatccgcgccgatcaggcgtggctgccccggtggcggctgggtcagcaggtagccgctgacataacgcgccgccaggccgcgggaacgcaaacacgccagcatcaggtgggcgaagtcctggcagaccccgcgccgccgctccagcacttccaccagcggcgtcgccacctgggtggcttcggcatcgaaggtgaactcgctgaagatcttttccatcaacgcttgcacccccagcaacaacggacgcccggcggggaaacagctttcggagaactcgacgaagcttttcttcaagtgcacataaggcgattcgaagcggtaacgacacgcctccatcaaggccgcggacaacggccggctgctgtaggtcagcgcactgcgggtggcgtcccagggcaatgagcgggtgaagtccagcgcaggccgggccagcacctccaccatcagctgcgcattgaccagcaactcgtcatgggggcgctcgaacgccagccgggtcagtgggttgccgaatacgtccagctcgtctcgacgggtggtggggtcggggctgatcagcagttcctgctggctgcaatgctgccaggcgcaggcccgcggccacaggtgcgccagctgctgggccagggaaaccgggctgtcgtagtgataatgggtatcgtggaagatttggtaatgagcgctcatcagacggacaccgtttgttggctgacatcgtcgacatgggcgaaatgccgcagcgccaggcggtcggagacctgcccgctggcatcggcgatttcctgcaacaggtcggccaggccttcgagcgccgcacgcacgctggcttcgccgaacagcgggttttccaggcagcccaggtcgaagcgccccagacgccccaccagcttgggcaaaccggcctcgcgcggtacgccgaactcgtcgttcaagcgattgagggtccgggtcaccagcttcagctggaacagcaccgcatgagggttctgttcgtcgagcagcaacaggtcgagcaccgggatcagttgcgccaccgccaggtagcgggaacggtaggtgatgctgctgttgcccagttccagcagccactccagcccggcctggtcgaacgcggtggcgctgcgcaggaaggctgccaggctgctgctgagaaactgcaggcgctcgatgcgtcggccaatcatcaaaaagcgccagccttcgtcgcgggtcatgtcgtccagggcgaagcccgacagcgccgccagggacatcaccaggcggttgaggaagtccagcagctcgccgaagtccggctcgcgggcttccagcgccaaggcttcgcgctgcaattccaccagcgcctgccagttctcccgcgaaagcttgccgcgcacctgggacgccgcccactgcaggcgctgcaggttggaacgcaggctgaaggaccagtcgtccccctgcaaggccgccaacaaacgctcgggcagttcgccttcgtccggcagcagcatcaggctttcgcccagctcgaccgccgcctgcaaggcctgcgggtcatcgccgtcgacatagcgcgccagcatgatccgcaacagccgcgcactgccatcgcaacgctcgcagtaacggccgaaccagaacaggttttccaccacccgcgacggcaggtacggatcgcgccgcaccagttcatgcacgccgatggtccgctggcctttccactgttcgccgctgggcgcacgttcgcccagcacccaggtgtccttgctggcgccgccgcgctgcatcgataccacctcggcatcggcttcggcggccacccgggtcaagccgcccggcagtacccggtaaccatcgcggctggccacggcatacacccgcatgccgatggcacgcggttgcagctggccgtcctcggcctgccagaccggcgcctgggacagctgcgccagttcctgggcgacataggcataaggccgcgcccgcatgcgctcggccagggcttggcgctctttctcgcagaggtcgcgaccgaacaatggagcaaagctctgggacgggaacgccggcttgatcagcaactccgggagtttctccagggcctgggccagcaccggcgcctcgccgcaccaccaggtggcaacagacggcagaatcagttcttcgccgaacaggtgctcgctgatcttcggcaggaaacccagcaagcctggcgactccagcacgccgctgcccagggcattggccaccagcacccgcccccgccgcaccgcctccagcagccccggcacgccgagggccgagtcggtgcgcagttccagcgggtcgcagaagtcgtcgtcgagccggcgcatgatcgcgtgcacccgccgcaggccgctcagggtcttgaggtagaccgtggcgtcgcgcaccgtcaggtcgccgccttccaccagcggataaccgagctggcgcgccaggtacaggtgttcgaaatagctctcgttgaaacgtcccggggtcagcagcacgatcagtggcgcttcgtcatcccggggcgcctggcgggccagggtttcctgcagggtgcggaagaacccggccaggtgctgcacctgcagatcgcggtacaggtccggaaaggcccgggacacgatcatgcggttttccagggcgtagccggcaccggacggcgcctgggtacggtcggcggtgacccaccagcgcccgtccggggtgcgcgccaggtcgaccgcgtacaggtgcaggaaggcgccatccggcggctggatgccctggcacggccagagaaagttgttatggccgaagaccagctcggccggcagcaggccctcgctgatcagccgctggggcccatacaggtcggccagtaccgcattgagcaaacgcgcccgctgcgcgatcccggcggacagctgctgccattcatcggcggcgatcacatggggcaacaggtccagttcccacggccggtcggcgcccttggggtcggcatagacgttgtaggtgacgccgttttcctggatctgccgggtcagcagcgcctggcgctgcatcaactgcgccggcgtgctgcgctgcaactggtcgaacagccggcgccagtgcgggcgcaccgcgccgctggcgtcgagcagttcgtggtaggtacccgccgtcagcgggtagtggtcaagcaggtcaggcatggaaagctcggcagacggcaaggtaagtcagattaacgcagacacatgacgcccggatatgcgaaacatccgggcgtcgcgtctgctttagaaacgtcgcaaatcgagtgtcatcggcaactcgtcgttgatcgtcaggctcggcaccgacaaggtgccggggctgtgccccaggcggaagaagcgcgccatgcgccggctctcggcctcgttggcattcaccggcaggctgtcgtagttgcgcccgcccgggtgggccacatggtattggcaaccgcccagggaacgctgcatccaggtgtcgagcaggtcgaacaccagcggtgcgtgcaccgggatggtcggttgcaggcagttgaacggttgccaggcccgatagcgcacgccggcgacgaactccccgacgcgcccggtgggctgcagcggcaccgcgacaccattgcaggtcaacaggtagcgctgcggcgccaacccggtgagcttgacctgcaagcgctccagcgacgaatcgacataacgcaccgtgccgccagcggagccctcctcccccagcacatgccaaggctccagggcctggcgcagctccagctcgacaccgccgaccgcgtaatcgccgaccttgggaaaacggaactccaggtgcgcggcgaaccactcggcgcgcaacgggtagccggcggcattgagctcgacaatgacatcggcgaagtcctgctcgatgaagtgcggcaacaggaagcggtcgtgcagctcggtgccccagcgcgccagcttggccggggcgtagggctcgcgccagaagcgcgcgaccaaggcccgcagcaacagttgctgggccaggctcatgcgcgcatggggcggcatttcaaaggcgcgcagttccagcaggcccaggcggcctgtagcaccatccggcgagtacagcttgtcgatacagaactcggcgcgatgggtgttgccggtgacatcgatcaacaggttacgcagcagccggtcgaccagccacggcgggcactcttcgcccggttcgggcatctgcgcgaaggcgatttccagctcgtacaaggcatcgttgcgcgcctcgtcgacccgcggtgcctgggaggtggggccgatgaacaacccggagaacagataggacaacgacgggtggttgtgccagtagctgatcaggctgcgcaacaggtccggccggcgcaggaacggcgaatccgccggcgtcgcgccacccaatacgaagtggttgccgccgccggtgccggtatgacgcccgtcgatcatgaatttctcggtggtcaggcgggtctgccgggcctcctcgtagaggaattcggtgcgctccaccagctcgtcccaactggcggacggctgcacgttgacctcgatcacgcccggatcgggggtgacgcggaagttgctcaggcgcggatcgctcggcggctcgtagccctccatcagcaccgggcaatgcaactcctcggcggtggcctcgatggcgctgaccaactccaggtaatcctccaggcgctccaggggcggcatgaacaggtacaagcgcccgccccgcgcctcggcgcagaaggcggtgcgggtcagccagtcggcggactggtcgatctgcggcacccgctcatcggcctcggccgcttcgccgtgttcgcgcagttgcgcgctgtccggcagctcgggcagctcctggttcgggtcggtggggtgcacataggggtactccgccgccgtcacccagggctgggacgccagcggcaggcgatagcccaggggcgaatcccccgggatcaaccggcaatgggtatcgcgcaggtaccagcggccgctctgccactggtcgcccctggcggtacgggccagcggcaggacctggccgatgaccttgtccaggccctggctgaacaccttgcgcaggcgcgcccgctccagctcgtccgccagccgcgaatcctcggcgctgacgttctgcggcaaggtgccttcacgccacaggtagtagaaattgtcttcgtaggccgggaatacaaagcgcgcgggcagcttcaagcgttcggcgacgctggcgaggaaacgcccggccagctcgctgtcggcgccatagtcttcatgctcgtcggcaatcagcgcggcgttgtgccagatcggcacgccgtcgcggcgccagtagcagttcagcgaccagcgcggcaattgctcgcccgggtaccacttgccctggccaaagtgcaccaggcccttgggcgcgtagtggttgcgcatgcgctggaacagctcggcggacaaccggcgcttgttcggcccgagggccgcggtgttccattcggcgccatctgggtcgtcgatcgagacgaaggtcggctcgccgcccatggtcaggcgcacgtcgcccgccaacaggtcggcatcgatctgccggcccagggcctggatcgccagccattgctcctcggtgtagggcttggtgacccgcggcgcttcccagacccgctccaccgacatctcgtggccgaactcgcattcacaaggctccacaaggccgctgatcggcgccgccgaggacggatcggggctgcaggccaacgggatatggccttctccggcaaacagcccggaagtggcgtccaggccgatccagccggcgccgggcaagtacacctcgcaccaggcgtgcaggtcggtgaagtcgacctcggtgccggacgggccgtcgagggatttgacgtcggcggtcagttggatcaggtagccggaaacaaagcgcgcggccagccccaggttgcgcagcagctgcaccagcagccaggcggagtcgcggcaggagccggaagccttgtccagggtctgctccggcgtctgcacgccgggctccatgcggatcaggtagccgatgtcttcgctcaggcgctggttcagggccaccaggaaatccaccgccggtatcggcgtgcagtcgatgccctcgaggtaagccttgaacttcggcgtcaacggcagggtttccaggtaaggcgccagctcgcgctgctcgtcggcggcataggcgaaggggattttctcggcgtagggctcaaggaagaaatcgaacggattgaacaccgccatctccgccagcagatcgacttcgatccgcagctcgtcggtcttctccgggaagaccaggcgcgccaggtagttgccctggggatcctgctgccagttgatgaagtgctgctcgggctgaaccttcagcgcataggagagaatccgcgtgcggctatgggccgccggacgcaggcgaacgatctgtgggccgagttcgaccgcgcggtcgtagcggtaatgcgtgacatggtgcaatgcgacatggatcgacacggcgtgcctcctgcggacctgaacgtacacgaaagcgcgcaagacttatgccagagcaccagtcccggggctttccccaacggctgtgggcagtacagcaccaaaagcgagcggtgcgtgcttcggcgtgcgcagggttgcacataaatgtggcgacaggatgtaaccggcggtcagcgcacccgcttcaggccggcttccagtcgctgcaggcgccggcgtttgcgcgccgccacttgcagcaccttgagcccgcgctggtagcgccgggtgctcatcaggtacagcccgaccaggggaatgcacaggacaaaggccgggaacagtcgctggcgggcgtccagcaggaccagcagcgcgcatgccaggcagaacaccagcgcgccgaacaaggcccaggcgccgcgcggatagccgcggatcaccagcaggaaacacaggctcatcagcagcccagcgcccagcatggccatcgcagcgtagttggcgacctggaagtcacgggggaaatacagatggggcacctgcgcggcggtcagcgagatgctgaagaccgtcgtcatcatcaccgcgatatgaatcaccccgaaacgccgcacatagggctgccaggcgagccattcggcggtcttgaggcgtagcagccggtcttcgacctgccgttgttgcggggttttccggcgacgtaacacgcggcgcttccttgagttgatgccaatcctgggggcgcaccttaacaaacccgaacgccgaaatgcacaacgccaaccctggggttggcgttgtgtccgtacagcagtggccttagcggggtacgaccggtttgcgggccggcttcttacctttgcccttggccgcatccgtgcgttccttggcggcctgcttgttgcgggccatcgcggcggccttggcctgttcgcgcttgtcccacgggttgctaccgtcgctgccgcgtggaggcaggccggtgtgctgggtgagaattttggtggtttccttggccactttgtggctgccagccggcgtcgaattcttgcggcgggcgctctggtagctgtcggtcgacggctgatgcaaaggaatcaactggttcttgcccggcccgatcaggtcggcgcggcccatgcgggtcagcgcttcacgcagcatcggccagcctttcgggtcgtggtaacgcaggaacgccttgtgcaggcgacgctgctcctcgctcttgacgatggtcaccccgtcactcttgtaggtgaccttgcgcagcgggttcttgcccgagtggtacatcgcggtggcggtggccatcggcgacgggtagaacgcctgcacctggtcggcgcggaaaccgttgcccttgagccacagggccaggttcatcatgtcttcgtcggtggtgcccgggtgcgcggcgatgaagtacggaatcaggtactgctccttgcccgcttccttggagtacttctcgaacatccgcttgaaccgatcgtaggatccgatgcccggcttcatcatctggttgagcggaccttcctcggtgtgttccggggcgatcttcaggtagccaccgacgtggtgggtcaccagctccttgacgtactccggcgactcgaccgcgaggtcgtagcgcaggccggaagcgatcaggatcttcttcacccccggcaacgcacgggcgctgcgatacagctggatcagcgacgagtggtcggtgttcaggttcgggcagatgccagggaacacgcaagacggcttgcggcacgcggattcgatttccgggctcttgcaggcgatgcggtacatgttcgcggtcgggccgccgaggtcggaaatgaccccggtaaaacctggaaccttgtcgcgaatctcttcgatctcgcgaatgatcgactcttcggagcggttctggatgatccgcccttcgtgctcggtgatcgagcagaaggtgcagccgccaaagcagccacgcatgatgttcaccgagaaccggatcatgtcgtaggccgggatcttctccttgccgtacgccgggtgcgggatgcgctgatacggcatgccgaacacgtagtccatctcttcagtggtcatcgggatgggtggcgggttgaaccagacgtcgatctcgccatgcttctgcaccagcgcacgggcgttgcccgggttggtttccaggtgcagcacgcggttggcgtgggcgtagagcaccggatcgttacgtaccttttccatggacggcaggcggatcacggtcttgtcccgggtcatcttcgggctggccaggatctgcacgaccttggcttcctggggatcttcgaccgggcctttttcctgctcgatggcacaggcctgggtgtcctgggtgttgacgtacggattgatgatcttgtcgatcttgcccggacggtcgatacgcgtggagtccacttcgtaccagccctgcggcgtgtcacggcgaatgaaagcggtgccgcgcacgtcggtgatgtcttcgatcttgtgcccgtaggacaggcgctgagcgacttcgacaatcgcccgctcggcgttgccgtagagcaggatgtcggcgctggcgtcgatcaggatcgagttgcgcacccggtcctgccagtagtcgtagtgggcgatgcggcgcagggaggcttcgatgccgcccagaacgatcggcacgtgcttgtaggcttccttgcagcgctggctgtagaccaggctggcgcggtccggacgcttgcccgccaggccacccggggtgtaggcatcgtcggagcggattttcttgtccgcggtgtagcggttgatcatcgagtccatgttgccggccgcgacgccgaagaacaggttcggctcgccgagcttcatgaagtcgtctttggactgccagttcggctgggcgatgatcccgacgcggaagccctgggactccagcagccggccgatgatcgccatgccgaacgacgggtgatcgacgtaggcgtcaccggtgacgatgatgatgtcgcaggaatcccagccgagctgatccatctccgccctgctcatcggcaggaacggcgccggtccgaaacattcggcccagtacttgggatagtcaaataacggcttggctgcttgcatgtcgatgaccggtataggtgtagatgagggcgcgtttatttacagagaaattcgcgggcgcggaatatagcacaaaaaataaccaattccgacgactatggtcggaaatcggtggcctgtagccgctgccgcagattgcgatcggctgcgcggcagacgcaacgctcacccatcgaacgaaggtcctgcggcccttgtcgcagcctgcggcagcggctacggctgtttattcgtcgtcgtcgaagttgtagctgcccggcgcgaggttctcgaagcgggtgtacttgccgatgaacgccaggcggataaagccgatggggccgttccgctgcttgccgatgatgatctcggcaatgcccttgtgctcggtttccgggtgatacacctcgtcccggtacacgaacatgatgacgtcggcgtcctgctcgatcgctccggattcgcgcaagtcggagtttaccgggcgcttgttcgggcgctgctcgagggagcggttgagctgggacagggccactaccgggcagttgaattccttggccagggccttgagggaacgggagatctcggaaatctcgttggtccggttgtcgccgctggaacccgggatctgcatcagctgcaggtagtcgatcatgatcagggcgatgtcgccgtgctcacgcaccaggcggcgggtccgcgcgcgcatttccgaagggctgataccggcggtgtcgtcgatgaacagcttgcgatcgttgagcaggttgaccgccgaggtcaggcgcggccagtcgtcatcttccagctggccggaacgcaccttggtctggtcgatacggccgagggacgacagcatacgcatgatcagcgattcgcctggcatctcgagggagtacaccagcactgccttgtcactgcgcagtacggcgttttccaccaggttcatggcaaaggtggtcttacccatggacggacgaccggcgacgatgatcaggtcggctggctgcaggccgctggtcttctcgtcgaggtcggtgtagccggtggacaggcctgtgatggcgttgtcggtgttgaacagggtgtcgatgcggtcgatggccttggtcagcaactcgttgacgcccaccgggccgccggtcttcggacgcgcttcggcgatctggaagatctgccgttcggcttcgtcgagaatctcttcggcggtacggccttcggggttgaaggcactgtcggcgatctcggtgctgatgccgatcagctggcgcagggtggcgcgctggcgaacgatctgcgcataggccttgatgttggccaccgacggcgtgttcttcgccagttcgcccaggtaacccaggccgccgacctgggaagtctggccttccttgtccaactgttcggacagggtcacgacgtcgatcggcatgttctgatcggccagcttggcgatcgcacggaagatcaggcggtggtcatgtcgatagaaatcgccgtcggagacttgatcgagcacccgctcccaggcgttgttgtccagcatcagaccaccgagcacggcctgttcggcctcgatggaatgtggcggcaccttcagggcagcggtttgcagatcgtattgctcgggagcggagatatcgttcatggccacttggttttttaggaaaagcaggggtttgaaaaactgagggtacagaaagacaaagggcacgacctgtaaacaggatcgtgcccgatgttaccggctagctcccgagggtgccagccgacaagtactgcttaagctgctaccacgacaacgcgtacggtggcttcaacttcagcgtgcaggtgcacggctacgtcgaattcacctacgttgcggatggtgccgttcggcagacgaacttcgctttttgcaacttcaacgccggaggcggtcagtgcatcagcgatgtcgtgggtgccgatcgaaccgaacagcttgccttcgtcaccagcggtggcagtgatagtcacttccagctcagccagttgggcagcgcgagtttcggcagaagcctttttctctgcagccagtttttccagctcggcacgacgcgcttcgaacgcagccaggttggcagcggtagcagcggtggctttgccgaaaggcagcaggtagttacggccgtaaccagccttaacgtttaccttatcgcccaggttgcccaggttggcgattttttccagcaggatcagttccatttggtaataacctcttaacttttaaccttcaccgttcgcaggaccgttatcggcgtctttcggcgccgaacgaccgcgaaaatcaatcaggctgtcgactatggccaacaccacgagcaacggatagatcagctgcataaacagcaacagcgttacgtacaaccccaccagccagaacctggccagtcgcccttgcgccaccagcccgtgaatcagggccagcccggcgaacaccagcggtacgctgcacaacggcgtcagcatcgccatctgtggaccgaggtccggtcccagcagcatgcaggccagcagcaacatcgccagtcccagcgggagcttgatcgcgcgaaactcgcgcccaaaaccacccgggttgtataacaacgcctgccagtagcgcccgacaatcaggctcagcacactgacgacctgcaacaaagccgcaatcaggccggtcaggaccggtgcaatcagtgaggcgagacgagcccgctcttcaaccgacagctgctggtagagatcaccgagggccaacggcaggatttttaccaactcctgcgagagcatctcgatctgggggcggtaagccacacccagcactccagcaaacaccaggcccagcgctatgctgaccagcagcacacggttccaggattcgcttgcgcgcaaaaccaacgcaaggcccgaagacccgagcaacaccatgagtgcgcgtggatcgtcggaatacagccaccagaacaatgccggcagcaatcccagggcgaggacaccaagggcgtcgctcaaaccgcgccgcaggagcaccaggcttcccgcagcagcacccaaccaatacaacaacggcaatgccgcacatccggccactaccagagtggcctgcatacggccgcgcatgatgaactcagctaaggcgcgcatgcattcaatcccttactacttgtcgactgcccggtctcagcggccgtggctgtcggtgtaggccagcagggccaggaagcgggcgcgcttgatagcggtggccagctgacgctgataacgagctttggtaccggtgatacggcttggaacgattttgccggtctcggatacgtaggctttcagagtgttgagatctttgtaatcgatctctttcacgtcttcagcggtgaagcggcagaatttacgacgacggaagaaacgtgccatgtaattggctcctcaaaaggtccgtggattactcgtcagcgttatcgctggcgtcgctgttatcgctgtcatcgccatcggcgctgtcagaatgctcaggacggtcacgacgctcacggcgctcactgcggttctcttcagccttgagcatctcggattggccagtgatggcttcttcgcgacggatgaccaggttacggatcacagcatcgttgtaacggaagttgtcttccagctcagccagggctttaccggtgcactcaacgttcagcatcacgtagtgagccttgtgaacattgttgattgcgtaggccagttgacgacggccccagtcttccagacggtggattttgccgccgtcttcttcgatcagcttggtgtaacgctcaaccatgccgccgacttgctcgctctggtcagggtggaccagaaagatgatttcgtaatgacgcatgaatgctccttacgggttgtagcctgccgctcaaaagcggtcagacaaggagtgaatgacacttgtgtgtcttgcctcagagataggcacatatgcgcctgccgcaacggcaaggggcgcaattgtagagaagggggaacagcggcgcaaggcaattggtgattatttgaacaactgggtgccagggcgcgccaaacctgccaagcaggcctgctcacgattgcagcacctcggtcgggccgctatcgcgagcaagcttgcgcctgcatgaagggaggaaactcaggccttcttggctgcgctcttggctttggccgcacgctggcgcgtggcttcgaacaggcacacgccggtagccaccgaaacgttgagactgctgacgctaccggccatcggcaggcgcaccaggaaatcgcaatgctcgcgggtgaggcgacgcatacccttgccttcggcgcccatgatcaggatggtcggcccggtcaggtcctggtcgtacagctcctgctcggcttcgccagccgtgccgacgacccacaggccgcgctgctgaagcttttccagggtgcgcgcgaggttggtcacggccaccagcggaatcacttccgcggcgccgcacgccactttacgcacggtcggggtcagggtcgccgatttgtctttcggcaccagcaccgccagcgcaccggccgcatcggcagtgcgcaggcaggcgccaaggttatgtgggtcggtcacgccgtccagcacgagaagcagcggcgcgccctcggtacggtcgagcaactcatcgagcatcgcttcgccccagacctggcttgggctcacttcagccacgacgccctggtgaacgccttcgacccaggcatccatttcgcgacgctcggcctgaccgaccgccacgcgattctgcccggccaggtccaccaacacctgcacgcgcggatcgctgcggccttcggccagccagatctgcttgacgcgcttggggtggtgacgcagcaatgcttctacagcgtgcacgccgtagatcttttccaactgactcatgacttggccttgggtttacgcgccccgccgcttttcgccgcaggacctgcgcccgctttcggcggacctttacgatgtttgctcggcttgctggaagccggcttgccggactttcccccagacgccgctttaccgccgctcttggcttcggccaacagcgcctgcttcatttcacggctcttgcgcacttcggcgtttttcgccgccgcatcgctggagcggtaggcctcgaccggcttctccttggccggaccacgacgcccggccttggctggggcaggctcggcagccgtcttggccggaggcacatcgacagcgccacgctttttgcgaccgatcggcgcactgatggttttttccgccatctcgaagtcgatcttgcgttcgtccagatcgacgcgcatgacccgcacttccacgctgtcacccaggcggaagctgcggccggtgcgctcaccggcgaggcggtgatgcacaggatcgaagtggtagtagtcgcccggcagcgccgtgacatgcaccagaccttcgacatagatatcggtcagttcgacgaacaggccaaaaccggtcactgcagtgatcacgcccgggaacgcctcgcccacgcggtctttcatgtattcgcacttgagccagttcaccacgtcgcgggtcgcttcgtcggcacgccgctcgctcatcgagcactgctcgccaagctgctcgagaatcgcctcgtcgtagggatagatgcgcgccttcggaatggtcatcgcaccggcacgacgcacgtgaggcgtgttctgcttggagtggatgacactgcgaatcgcccggtgcgtcagcaggtccgggtaacggcgaatcggcgaagtgaagtgggtataggcttcgtagttcaggccaaagtggccctgattgtcagcgctgtacaccgcctggctcaaggagcgcagcatcacggtctggatcagatggaagtccggacgatccttgatgctttccagcaaggcctggtagtccttcggcgtcgggccgtccttgcctttatgcagggacaggccgagctcgccgaggaaagcgcgcagtttttccaggcgctctggcggcgggccgtcgtgaacgcgatagagcgcggggatttcgtgcttcttgaggaattcggcggtggccacgttggccgccagcatgcattcctcgatcagcttgtgcgcatcgttgcgggtagtcggacgaatttccgcgatcttgcgctcggaaccgaagatgatccgggtttcctgggtctcgaagtcgatggcgccacgggtatgacgggcaccgagcagaaccttgtacagcgcataaagctgcttgaggtgcggcacgacatcggcgtactcgctgcgcagctgcttggcttcaccggttttcggctgctcgaggatagtactgaccttgttgtaggtcaggcgcgccttggagtggatcaccgcttcgtagaactggtaatcggtcatctcgccggatttggagatgaccatctcgcacaccatggccagacgatcgactttcgggttcagcgagcacaggccattggacaactgctccggcagcattggcaccacgcgctcggggaagtacaccgagttgccacgcacctgcgcctcgttatccagcgccgaaccgatcttcacgtaactggaaacgtcggcgatcgccacgtacagcttccagccaccgccgaacaggcgcagcttgccgggcttggcttcgcaatagaccgcgtcgtcgaagtcgcgagcgtcttcgccgtcgatggtgacgaacggcagatcgcgcaggtcgatgcgcttctctttgtccttatcctcgacttccggcttgagcttgccggcttccttcagcaccgcctcgggccagacgtgaggaatatcgtaggtgcgcaaggcaacatcgatttccatgccgggggccatgtagttgcccacaacctcgaccacgtcgccttgcggctggaagcgcggagtcggccagtgggtgatcttcacctcgacgaactggccgatcttggcgccggcattgcgacccggggtcaccagcacttcctgctggatcttcgggttgtccgccaccacaaaaccgattccgccttcttcgaagtaacggccgacgatgctctcgtgggcacgggacactacttcgacgatcatgccttcgcggcgaccgcggcgatccagaccggaaacccgggccagtgcacggtcgccatcgaacaccaggcgcatctgcgccgggctcatgaacaggtcgtcgctgccgtcatcgggaaccaggaagccgaagccgtcacggtgaccgctgatgcggccgaggatcaggtcgagcttgtccaccggcgcatatgtgccgcggcgggtgtagatcagttgggcatcgcgctccatggcgcgcaggcggcggcgcagggcttcgatctggtcttctgtggtcagaccaaactcttcgaccaactgttcgcggttagcaggcgaaccccgatcagcaaggtgctgaaggatcagttcgcggctagggatagggttttcatatttttccgcttcacgagcggcctcgggatcgagggactgccaatcggccattagataaatttcaccttgtctatatgcgggttagtttggcatacgcgtattgaaacgggaaatttcaggctaagacaggctccgaaaagtcctttagtggcttcagaaccatcctgtaaaagccgtcggcgaatttttttcaatattttcaagatcaggggtttacagcccaaaaggtggtccgtatagtgcgcgccatcgacgacggagacgctgtcgatactgcccagatggtgaaattggtagacacgccagcttcaggtgctggtggccgcaaggccgtggaagttcgagtcttcttctgggcaccaattcagagctgcagattgtttgaatcttcagactcctccaaaaacccgcgaaagcgggtttttgcattcttaagtgtttgatttattgaatctaagtcaaaacagggctttacagattcaaaggcgctccgtatagttcgccccatcaacagcggcaacgctgctgatactgcccagatggtgaaattggtagacacgccagcttcaggtgctggtggccgcaaggccgtggaagttcgagtcttcttctgggcaccacattcaagcttcacagcatagctgtgaagtctcacaaaaacccgcgaaagcgggtttttgcgtttctggcccacaaccatttcccccgccaaaacgcccccctcctccagggctatccagcccgccaagccgcacatgagaaacaatatcgtttatgattgttacaagtttttgcggcaccacagtgaggaaccctgcgaatgatgtttagaaacacctcccttccaacatcccttctgcgtggcttgaccatcactttgctgggcctggccctggcatctccattcactcaagcagccgatccggtttccctgacgctgtacaacggccagcacaaggaagtcggcgacgccatcgccaaggctttcgagaccaagactgggattcacgtcaatgtgcgtaaaggtagcagcaaccagctcgccagccagatcgtggaagaaggcgagcgctcccccgccgatgtgatttataccgaagaatcgccacccttgaacaaactcggcgagcaaggcttgctggccaagaccgatgcggcgacccttgaagtcctgcccaaggactacgtcgccggcaacggcacctggatcggcattaccgcccgcgttcgcgtagtggcgttcaacccgaagctgatcgacgaaaaagacctgcctgcatcggtgatggagttctcccagccacaatggcaaggcaaggtaggcttcgttcctaccagcggcgcattccaggaacaggccgtggcaatcatcaagctgcacgggatggacgccgccgaagaatggctgaccggcctgcgcgctttcggcaagacctacagcaataatatggtggccttgaaggccgtggaaaacggcgaagtcgccaccgtgctggtgaacaactactactggttcgccctgcaacgagagaaaggccagcttgactcgaagctgcactatttcaccggcggcgatgccggcggattgatcaccgtatccagcgccgcggtactcaagtccagcaaacatcccaaagaagcccagcaattcctcgcctatatggccagcgaagaaggccagcgcgtcatcacccagaccaccgcagaatacccgctgcgcaaaggcctggaatcggatcgaggcctcaagccgttcagtgaactgcaagcgccgaaagtcaccccggccgacctcggcaacgccgaagaagccctggaactggaacgcgaagtcggcctgaactgatgaacgcatcgctgcccgcccccgcctcgcgcacgaactacataccgaggcgcaaggggccatcgatctggctgctgctaccggtcctgttgctggtcgggctcagcctgctgccattgctctatgtcgggctcaaggcctggcaggccggctgggccgaagccctgcacctgctgtggcgaccctatgtattcggcctgctgcgcaacaccctgctactgctcattggcgtgaccgttacctgcgccatcgtcggcctgtcccttgcctggctgctggaacgcagcgacttgccggggcgacgcctctggggcgtgatcctgtgcctgccctttgccgtaccggcctttgtcagcagcttcacctgggtctccctcagcgccagcttcgaaggcctgggcggggccatcctggtcatgagcctgtccaagtacccgctggtattcctgcccgtcgcggccaccttgcgcaatctcgatccctccctggaggaatcggcccgcaccctcgggcagaatcgctggggcgtgttcttccggatcaccctgcccctgctctggccgtcgctgctggccggctcgctactgatcgccctgcacatgctggtggagttcggcgcactgtcgattatcggcctgcaaaccttcaccaccgcgatctatcagcagttcgaactggagttcagcaatgccaacgcagcgatgctgtccgccgtgctgctagcgctgtgcctggccctgctgtggctggagttgcgggatcgcggcaaaggccgccatgtacgaaccggccaaggcgcggcgcgacatgccgagcaggtgcgcctcggcaagtgggcgattggcggacaactgtactgcgcgctactgaccctgatcggcagcggcattccgctgggcatgctggcgtactggctggccgtcggttcatcggccgctttcccggtggccgccatcagcgaagccctgctctcctccctggcgctatcgttgggtggcgcggcgctgtgcctggtgctggcggtaccggtcggactgctggtagtgcgccacaaaggtcgcctggcactctgggccgaacgcctgccttacctgctgcacgccctgccaggcctggtaatcgccctgacgctggtgtactttgccctgcactacgtgccggcgctgtatcagacctcagccctgttgctgatcgcctacgccctgctgttcctgcccctggcgcaggcaccgatccgcaccgccctgaacaaggccgcgccgcagctcgaggaagccgcccgcaccctgggcgcctcctcattcacggccttctgccgcgtgaccctgccgatcattttccccgctctgggagccgccttcgccctggtattcctggatgccatgaaggaactgacggctaccctgctgctcagcccgactgggctgaatacactggcaacggaagtctgggcgcacacggcgaatgtggagtttgctgccgcagcgccttatgcggcgctgttgatcttggtatcgggactaccggtctatctgctgacgacacggatgtatctgcgccgctgagcctactcctacagaaagccttctgtaggagccccgccccgagcattcaagcctcgtgaacactcaagcccggaactgccccaggctggccttcaattgggccgccaggctatccagcaccttgccgctggccgtggtctccaccacagcctgagctgcacgctcagcctgggcatgaatggtctcgacccggccgcgcaccgcttgcgcgccctgagcctgatgggcggccgcctgggtcgccaggccaatcgccgcgtgcacctgctctaccgacgactgcaccgattgttgcaaccgcgcactgtcgcgcaacaccagcaacccttcgttggcctgccttccagcctggccgatcgccgccaccgcctcgcgcgcgccctgctgcagcgcaccgatatgcgcctggatatcgccggtagagctttgcgtcttgctcgccagcgccctgacctcgtcggccaccaccgcaaagccgcgcccggtttccccggcccgcgccgcttcaatggccgcattcaaggccagcaggttggtctgctcggcaatcccatgaatcaccgtcaacaccacctcgatctgttcgctctgctgcgccaggcgttcgatgaccttggcccccgtatcgacctgccccgccagtgcctcgatcagaccgcccacctgggccgaggtccgggtgttttcatcggtcgcctgacggatctccaccacctgctgcaaggccgcctgcattgcctggctttccgcctgggcttcgtcagccatctgcgacagggcccgcaaactctccgccacctcgtcacgctgagcctcggccgcggcatccgctccggcattacgcaggctcatcgcgccgatttcgacgccagtacgctgcgccacatcgccggcctcacgcacgatcggctgcaacttgtcgacaaagcgattgaccgccgaggccatgtcgccgatctcgtcattgctattgagctggacccgtttggtcagatcaccctcaccggcggccagatcgtttaacgcggcgatcagcagatgcagcttgctgaccactcgccgccccagcaccaccgccagcaacagcaagaccccgcagccgaccagcgccaggcccatgccgatgcgccagcgcagggtggccgccgcgtcctgcacggtacccgcggtgttggcctgcatgtccgaagcgctggtctgcgccgactgcaggcgcgcacgcatggccgcagaactgtccgccgaagcgcccttgaggctatcgccgaccagctggtcgctattggcgatcaaggcctcgaaacgcttgtccagcgccgccacatccgcctcgaccgacgccgtggaaacccccatcagcaccttgccgatctccacgccgttaggactgatggaggcttccaggtagtagaccgatggatcgttcttggccgcgtctagcaccttgtccagggcacggtcgcccttgcccttttccagtagcgccttgttgatcgggttttcccggttcagatagcgggtcaggtgctctccattggcgtcgtcgtacaccacgaacagcacgttgggattgcgctgggcgcgccgggcgaactcggagagggtcggaacgtcgctgtcccacatggcgcgtggggccaccgaagcgagcaactgggccatatcgttggctgaatccttgagatccttctccagcgtcgtgcgcaattgcgcctgctcctcttccaggcgcgaggagagcccggcggtcaagcgttgccgggtgctgctggaaaggctttccaggctcgaagtgacctcgcgagccgcctgttccagttcgccggacagcttctggctatcgacgcccagacgaatggccagatccgcctccagcgccgtcaccgtgctccgggtcagggcaacggcaaccaacacctgcaccaaaagagcgataccaagggtaacgaacacaggccgcaacaaacggctttgtaacagtgagagaacggccgacacaggaaatccctctacttcaacgccatcaaattgatggcactctggaagggcaaatcacagcaagggtcgtgccgcctggcaggcagaaacgacaaaggcccctgaggaggggcctttgttttttacatcaacgacttatcaagcaaacgggtgacgcagaacgatggtctcgttgcggtccgggcctgtcgaaataatgtcgatcggcgcgccgaccagctcttcgatacgcttgatgtaggcacgggcagcggccggcagctcttccagggtcttggcccccagcgtcgactcgctccagcctggcatctgctcgtataccggctccaggccgatgtagctgtcagcatcggttggcgcgtcgatgactgcgccatcctggtttttgtagcccacgcagatgttgatggtttccaggccatccagcacgtccagcttggtcaggcacaggcccgagatgctgttgacgtcgatggcgcgacgcaggatgacggcatcgaaccagccgcaacggcgggcacggccggtggttgcaccgaactcatggccacgcttggccaggaaagcgcccacgtcatcgaacagttcggtcgggaacggacccgaacctacacgagtggtgtaagccttggtgataccgagaatgtagtccaggtacatcgggccaacgcccgaaccggtggcgatgccgccggcagtggtgttggagctggtgacgtacggataggtaccgtggtcgatgtccagcagcgagccctgggcgccttcgaacatgatgtccttgcccgcgcgacgcagctggtgcagctcggcggtcacgtccagcatcatcggcttgagcagctcggcgtattccatgcactcgtcgagcgtcttctggaagtcgatggccggctctttgtagtaattgaccagtacgaagttgtggtagtccagcaactcgcccagcttcgcggcgaaacgctcgcggtggaacaggtcgccgatacgcaggccgcgacgagcgaccttgtcttcgtaagccgggccgatgccacgaccggtggtaccgatcttctgctcgccgcgggccttttcacgcgcctggtccagcgctacgtggtaggacaggatcagcgggcaggatgggctgatacgcaggcgctcacgcaccggtacgcctttctcttccagcttgacgatttcacgcagcaaggcgtccggcgcaaccaccacgccgttgccgatcaggcactggacgccttcgcgcagcacacccgaagggatcaggtgcaagacggttttctcgccgtcgatcaccagggtgtggccagcgttgtggccaccttggtagcgcactacggcggcagcatgttcggtcagcagatcaacgatcttgcctttgccctcatcaccccactgggtgcccaggactacgacattcttacccataacacttgtcctcattcgcgcaaacttggtgccggcaacggccggcgggaaaactcaagaagccagcggcaatacttgccaaagcccgttctgctgaatcaattgccggtcgcagtccgcttcacgggcggcggccaatggttgtccaggcaaggcctgaaccacgcgctgaccctcactgcgcaactggcaaacctgctgccagagggctgcatccgtactgtccggcatccagataccgccagacggtagctcgatctcagcacgccccagggtcaccagggttttcaaatcggtagagaagccggttgccggacgggcgcgaccgaagtcggcgccgatgtcgtcgtaacgaccgccctgggcaatggactggccaacgcccggcacgaacaccgcgaataccacaccggtgtggtagtggtagccacgcaactcgcccaggtcgaagtacagcggcaattcagggaaacgcacggaaagacgctcggcaatcgccagcaggtcgtccagggccgccagcaccggcgccggcgcattggccaggcgttcgcgggctgcagccagcacttcacggccgccgcacaggtcgaccagcgcccgcagcatgccggacaggtcggccggcagaccttcggtcaaggtaatgacttcgtcgatggccttgcgttgcagggcatcaaacagttgctgctccacttcgccggagagaccggccgcgcgggccaggccacggtagataccgacatgccccagatccatgtgcacatccggcacatcggccagttgcagcatcgccagcatcagactgataacttccacgtcgctgctcgggctcgcatcgccatacaactcggcacccagctggatcgggctgcgcgaggacgacaaggcacgcggctgcgcatgcagcacgctaccggcgtaacacaggcggctcgggccttcgcgacgcagggtatgcgcatcgatacgggccacctgcggcgtaatgtcggcgcggaaacccatctgccgacccgattgcgggtcgatgaccttgaaggtacgcagatcgaggtcctggcccgcgccagtcagcaaggattccaggtactcgatatgaggggtcacgacgaactcgtaaccccagctctggaacagatccaacacctggcgacgcgcaacttcaatgcgcgcagcctcaggtggcagtacttcttcgatgccatctggcagcagccagcggtctaccgttgccattacgccattcccctgtgatccaggcggccagcctatgggcgggccttgagtgaagcagaaaatgatcggcccatgtgcaaaccacgcgcatgggcgacggggcgaaaagcctgaaaccggcttcgccactcactttcctcgaaaaaaactgtcgagtcgttcaactcgccgtcttgcaccaacaaccacaatcaaacgtgcagacgcaaaaaagccgggaatttcccggctgccgcatcatacactcgttttcccaaaggatcaccccgccagacactttagccgccgggcggggcgattcaggtcaacgtcgcatcaaggcttggccttttccaggtaacggaaaaagtcgctgcttgggtccaggaccatgacgtcggatttgttcgcgaagctttcacgataggcacgcaggctacggtagaaaccgtagaactcctgatcctgaccgtaggccttagagtagatggccgcagcctgggcgtcgccatcaccgcgaatctcttccgactcacgataggcttcggccagcagtacgcggcgctgacgatcggcgtcggcacgaataccttccgccagctcgttacccttggcgcgatgctcacgcgcttcacgctcacgctcggtgctcatacgctcgaagacgctgcggttcacttccttcggcaagtcgatggtcttgacccggacatcgaccacttcgatgcccagctctttctcggccatcttgttgagcgaagccgtgatgtccgccatcagcgcatcacgctcaccggaaaccacttcgtgcagggtgcgcttgccgaactggtcacgcaggcccgactccagacgacgggaaagacgctcgtcggcgatctgcttgaggccggaagttgcggtatagaaacgctccgcatccttcacgcgccatttggcataggcatcgaccatcacggctttcttttccagcgtcaggaaacgctgggtcggtgcatccagggtcatcaggcgagcgtcgaacttacgcacctggttcacatagggcactttcacatgcaggcccggctgaacgtcagcctggaccacacgaccgaactgcagcaacaccgcgcgctcggtctgagcgacgatgtagaagcagttccaggcagcgatcgccacgacgacgccaacgataagggcgatcagcgatttattgctcatcagcgactctccctggtacgcgcttgctgttgctgcagatcagctgccgcacgcgcattcgcttcgttgctgctggctgctgagccggtcaccggagcgctggtgctgcggccactttcgaccattttgtccagcggcaggtacagcagattgctctggccgttcttgttgccggtcacgagaaccttgctggtattgctgaagacttcctgcatggtgtccaggtacagacgctcacgggtcacttcaggtgccttgcggtattcggccaccagcttggtgaagcgatcggcctcacccttggcgcgggaaaccacttcgccacggtaaccgttggcatcctcgatgatgcgctgggcctgaccacgggcttccggcacaacgccgttggcgtaggtttcagcctggttgcgcgaacgctgctcgtcttcacgggcgcggatcacgtcatcgaaggcttcctgcacttcacgcggtgccgctgcgctctgtacgttcacctgggtaacggtgataccggtgcgataggtatcgaggaagcgttgcagacgctccttgatttcgctggccatcaactcacgaccttcggtcagtacctggtccatcgcggtggagcccactacgtggcgcagcgcactgtcggtagcgtgctgcaggctgatttccggctgatcgacgttcagcacgaagtcctgcaggttgctgatcttgtactgcacggtcagcggcacttcgacgatgttctcgtcttcagtcagcatttgaccctgcttggtataggcacgctcgcgcgtgacgttttccatgtacttgcgatcgatcggcgggaagtagatgttcaggcccgggccgacggtttcgtagtacttgccgaagcgcagcaccacggcctgctcctgctcgtccacgacatacaccgcgctgtacagccacacggccgccagcacgaccagaccgataccgagcaggccgagaccgccgcccttgccggaactgccaccatcgtcaccacgtttcttgccaccaccgaacaacccattcaggctttcctgcagcttgcggaaggcctcgtcgagatccggtggccccttgcggtcgccattgttgcggcgcttaccaccccaaggatcctgattattcgagttgccacccggctcattccaagccatagcgctctccatctgataaagcaaagacgcacccacggcgcgccgaccaatgctacagaatgcctgctacagcggcacaaccgctttctcaggcttttattgcaaagtgtgttgctcgatgaactccagcggctgcatgccttcgcggcttaccagtcgattcagctcgactcgcggcaagcggacagccagcaggctgacaccttcctcgtcgtgatcttctttctgcactgcgcccaactcgaagaactgcgctcgcagtcgagcaaaacgctgcggcaagcgcaaggtgcctacaaacaaatcctcgccgagcaactcggcaatggcctgcttgagcaggtccagcccttgcccttcacgagccgacaaccagacccgctgcggcttgccatcggcatcgcgctggatctgcgggtcgaccccctcgagcaaatcgagtttgttatagacctccagtatcggcaagtcctgggccccgatctcgccgagcaccaccatgacctgttcgatctgggccatgcgctccggctcatgagcatcgatcacatgcagcagcaggtcggagttgctcgactcttcgagcgtagcccgaaacgcctcgaccagtttgtgcggcagatgacgaatgaaccccacggtgtcggccaacacgaccggaccaagatcgtccagttcaagccggcgcaaggtcggatcgagggtggcgaacagttggttggccgcaaacacatcggactcggtcacggagttgaacaaggtggacttgccggcgttggtgtagcccaccaacgataccgaaggaatgtcggcacgcttgcgcccacgacgagcctgctcgcgctgactgcggaccttctccagccgggccttgatctgccgcaggcgaacccgcagcagacgccggtcggtctcgagctgggtttcacccggaccacgcaggccgataccgcccttctgccgctcaaggtgagtccagccgcgaaccagacgggtactcatgtattcaagctgggccagttctacctggagcttgccttcgtgagtgcgggcgcgctgggcgaaaatatcgagaatcagacccgtgcggtcaatcacgcgacactcgaaagcacgttcgaggttacgttcctgactgggtgtgaggatgtgattgaaaatcaccaggtcgacctgttcggctttgaccaggtcgcgtaactcttcgaccttgccgctgccaaccaggtacttggcggttggccgatgacgcggcacgttaacaaacgcgacggtctcggcgccggccgatattgccaactcctgaaactcctgcggatcttcgcgcgcctcagggtcctgaccatccaagtgaacgagaattgcacgttcaccaccaccgtggcgctcaaagaacaaaggagactcctatcaggcgttacctggctcagcgtcaccctgttcggattcggatgcgctaggcaggcgaattggacgaaccggcaccactgtcgagatagcgtgcttgtaaaccatttggctgacggtgttcttcagcaggatgacgaactggtcgaaagactcgatcgtaccttgcagcttgatcccgttgaccagatagatggaaaccccaactttctctttacgtaaagtattcaagtaagggtcttgtagcgaatgcccttttgacatgtgccgcactcctttaaggatcaataataaaaaatcggaaaacagatggctaaaaccgccccacccccaaggatagacggcaattgcaaggactcagctcaatatggagaccgttcccaggtatttcaaggcgcgtggcagattgtcgcaatccaggctgtccagccagtgtaaatcagcccagctgcgtaaccaggtgaactggcgcttcgccaattggcgcgtggcaatgatgccgcgctcctgcatctcggcgaatgtcagcttgccatccagatgatcccagacctgtcggtagcctacagcacgtatagacggcaacccggcatgcaggtcacttctagaacgcagagctacgacctcgtcgacgaatccctgttccaacataattgtgaatctttgtgcaatacgctcatgcagtacctgacggtttgccggggcaatggccaagttcgcgacagtatagggcaattgtccccgtcccgaagcggctgcttcagtactttgcgcagattgtcgcagtctgtgggcggtcatgctcaggccgctgacccgatagacttccagcgcccgagtcaggcgctgcggatcattgggatgaatccgcgccgccgattcagggtcgattatcgccagttggtcatgcaaggcttgccagccaaggcgtgcggcctcttcttccagctccgcgcgaacctgtgggtcggccggcggcatgtctgccaggccttcgagcaaagccttgtaatagagcatcgtgccgcccaccagcagcggaatcttgccgcgcgcggtgatatcggccatggcggccagcgcatcggtgcgaaaatccgccgccgagtagctctcggccgggtcgaggatatcgatcagacggtgtggaaactcggccaggatttccttggacggcttggcggtgcctatgtccatgccacggtagaccagcgccgaatcgacgctgatcagttcgcaaggcagaaccttggtgagttcgatggccaggtcggtcttgccagcggcagtcgggcccatcaggaagatcgctggaggaagctggctcatcaacgaccgcgcaagaagagtttgtccagatcgtccaggcccagctgggtccaggtcggtcggccatggttgcattgaccgctgcgctcggtgttttccatatcgcgcaacaagccgttcatttccggcagggccaggcggcgattggcacggatcgcaccgtggcaggccatagtgcccagcaactcgttgaggtgcgcctggatacggtcgctggtgccgtattccatcaggtcggccagaacgtcatgcaccaggcgattggcttccgcctgcttgagcaaggccggaatctgccggatcgccagcgattccgggcccaggcgctgcaactcgaagcccaggcgctggaaccagctgacatgctcctcggcacagtcggcttcgcgctggctgaccgcgatcgattccggtaccagcagcggctgaccactcaggccttcgctggccatcgctaccttcaggcgctcgtacatgatccgctcgtgggccgcgtgcatgtccaccagcaccaggccctgggcgttttccgcgaggatatagatgcctttgagctgcgccagcgcatagcccagcggcgggatatcgccctgagcatccggcaaggacgctgcgccggattccggcagtggcgcgaagaactcacgataggcgctttgcgcctcggccgccggcaacactggctgcggacgcggcgtgtactgatactgataacctgcacccgagccagcccccggtggattgaacgccggctgggcctgcggctgctccagcgtcatgtttgccgccaggcgcatttcgccctggggaccgaactcgccagcctcgatcccgctcggccgcacgatgccggcgaccgcggccggcgctgccagatggtcttccggccggacatcgcccaaggcgcggtgcagggtgccatacaggaagtcgtggaccatgcgtccgtcgcggaagcgcacttcgtgcttggtcgggtgcacgttgacgtcgaccaccgccgggtcgacttcgaagaacagcacaaaggtcggatgccgaccattgaacagcacgtcacggtaagcctggcgcaccgcgtgggccaccagcttgtcgcgcaccgcgcgaccgttgacgtagaaatactgcaggtccgcctggctgcgggaaaaggtcggcagacctacccagccccagagatgcaggccattacgttcaacttcgatcggcagcgcctgctcgagaaagcccgaaccgcacaccgccgctacccgccgcgcgcgcgtcacatcatcgttggcttcatgcaggctgaggacgcttttgccgttatggcgcaggtgaaaagccacgtcgaaacgcgccagggccaggcgcttgatcacttcctgcaggtgatcgaactcggttttctcggccttgagaaacttgcgccgggccggggtgttgaagaacaggtcgcggacttccaccgaggtaccgaccggatgggccgccggctgcacacgcggggccatgtcgcggccttcggtttccacctgccaggcctgatcggcatcgcgggtgcgggaagtcagggtcaagcgcgcgaccgagctgatggaagccagtgcctctccacgaaagcccaggctcatgacctgttccaggtcctcaaggttgcgaatcttgctagtggcgtggcgcgccagggccagcggcagatcgtccgcggagatgccgctgccgtcgtcgcgcacccgcagcagcttgacacccgcctgctcgacatccacatcgatgcgcttggctccagagtcgaggctgttttccagcaactccttgatcaccgaggccggacgctcgaccacctcaccggcggcaatctggttcgccagtcgcgggctgagcagctcgatgcgggcgctgctgatgactgcgtcattcattccttggccgccagttctgtacccgggatggtgagggtctgaccgattttcagctcatcgctgctcaggttgttggcgctgcgcagagtggcggcggaaacctgataacgcacggcgatcatcgccagggtttcccccgggctcacgcgatggtcacgaggtccctgggcaatcttcccggaatcacgcagccaggcgatgtaggtgcccggcggtggattctgctggaagaactgccgcacgccgctgctgatggagcgcgccaatgcctgctggtggctgaccgtggccagcttggacgcttcgttggcattggagataaagccggtttccaccaggatcgacggaatgtccggagacttgagcaccatgaacccagcctgttcgacgcgctgcttgtgcagcggggtgacccggccgatgttgctgagcactttctggccgacgttgaggctggaagtcagcgaggccgtcatggacaagtccagcaatacgccggcgagcatccggtccttgtcatcgaggctgacgttgccggccccgccgatcaggtcggaacggttttcgctgtccgccagccagcgggccgtctcggacgtggcgccacggtcggagagcgcgaacaccgaggccccgaaggccgcgcgggacggtgccgcgtcggcgtggatcgagacgaacaggtcggcgcctttcttgcgggcgatctcggtgcggccgcgcagcgggatgaagtagtcgccagtacgggtcagctcggcgcggaaacctttgaggccgttgatctggcgctgcagttcacgggcgatggccagcaccacgtctttctcatgctggccgcgcgagccggaggcacccgggtcctcgccaccgtgaccggcatcgatgaccacgacgatatcgcgcttgccggccggggccagtggcagcttgatctcaggcttggtcggcgttaccgggaccgccggcacagtcgcgacattcggcgcgggtggcggagtcggcgcggcatcggccgggttgtcgaacaggtcgaccaccaggcgattgccgtactgggcattgggcgtcagggtaaaactcttgggggtgacggcctttttcaggtcgatgaccacccgcaggtcggtaggcgtgcgctgggccgaacgcatggcggtaatcggcgtattcgccgtggagacattcagcggcccgccgagggtcgcaccgttgatatcgatcaccagacgatcaggggccgtcagggtgaagacgctgtgctggaccggcccggacaggtcaaataccagtcgagtgttatccggtgcccgccacaggcgaacgctgcggacctgtgtagcggccagagcgtcgacggccaatgccgtaagcaacagtcctacgacagcaaccaacgcgcgaatgcgcatacctaaccccatcaattatttgaattccaacgccaaagcggcacaccaggcctcgccacgcgagccttgcgacaacaaatgcagggagcgcccgctgttatgcgggctaatggtaatggtcaggtccggctttggcaaaaagcccgcaccacgctggggccactcgatcagacacagtgcatcgccctcgagataatcgcggatgccgagaaactccagctcttccggatcgaccaggcgataaagatcgaagtggaaggcccgcacatcgccgatctcgtaaggctcgaccagggtaaaggtcgggcttttcaccgcgccggcatgtcccaggccacggataaggccccgggacaatgtggttttccccgcccccagatcgccttccagaaagatcacacccaccccttgagtgacctgcgccaggcgcgcgccaaaggcgatcatggcgtcttcgtctgccagatacagggttatttcagacacggtgattgctcctccagcaactgacgaatgaccgggatcagatcgctggccgccagcccccggcccaatttaccttgatgctcgcccgcgacggcatgcagccagaccgccaggcaagcgctatcgaacgtcggcatcccctgggccagcagcgccccgaccagaccggccagcacatcccccagtcccgccgtggccatggccggatgcccccggtcgcaacgggccaggtggccatcagggctggccaccagacttccggcgcccttcaggatggcgacagctgtgtattttttgctcagcgcccgtacggcggctgggcgatccgcctgcacctgcgcggtggaaatccccagtagccgtgcagcctcccccgggtgcggggtgatcacgctgcccgacggcaaggtcaaaccgcccttggccagcagattgagcgcatcggcatcccagacctggggccgcggtgcattggcggcggcagataaaaggctgcgcccccaggccgcctgccccagcccggggcccgccacgatgaccgacgcctgctccagcaagcccatcagctggttggccgagtcggtgcccagggccatgacctccggaacccgcgccagagcggctgcaacgtgctcgctgcgggtcgccagagaaaccatcccggcaccgctgcgcagggcgctctcggcgcagagcagcgccgcaccgccaaaaccgcgatcgccgccgatcagcaacaggtgcccgaactggcctttatgggcgcttggcgaacgggcagccagccgcggcagcgtgtcgggcgtcaacggctgaatgtcgggtaaagggtgttttgtctgcggcatgcgtcttcgggctccgatgtctggcagaattatacgcacctcagccccggtttctctcgcctcatgcctgccattaccaccgatctgcccgccctcgcccaatcgatcaaggattggggccgcgagctgggctttcagcaagtcggcatcagcggcctggacctggccgagcatgagcagcacctgcagcgctggctcgaggcgggctaccacggcgaaatggactacatgggcgcccacggcagcaaacgctcccatccggacgaactggtacccggcaccctgcgcgtggtgtccctgcgcatggattacctgcccggcgacacccagatggcgcagcgcctggcccagccggaaaaggcctatgtctcgcgctacgccctgggccgcgactatcacaagctgatccgcaagcgcgtgcagcaattggccgagcgcatccagaaagaaatcggcccattcggctatcgcgccttcgtcgacagcgccccggtgctggaaaaagccatcgccgaacaggccgggctcggctggatcggcaagaacaccctggtactcaaccgcaaggctggcagctacttcttcctcagtgaactgttcgtcgacctgcccttgccggtggacgagccccacgccagcgagcactgcggccgctgcacggcgtgcctggacatctgcccgaccaaagcctttgtcggcccttatgtactggacgcccggcgctgcatttcgtacctgaccatcgaactgaaaaacgccattcccgaagacctgcgcccgctgatcggcaaccgggtgttcggctgcgacgattgccagatcgtctgcccgtggaaccgcttcgcccgcccttccggcgaaggcgacttcaagccacggcacaacctcgacaatgccgagctggccgaactgttcatgtgggacgaggacaagtttctcagcagcaccgaaggctcgccgctgcgccgcgccggctatgagcgctggctacgcaacctggcggtggggctgggtaacgcgccgtcgagcattccggtgctggaggccctgaaagcccggcgggattacccgtcagagctggtgcgcgaacacgtggaatgggcgctgaaacagcacgccagccgtcactgctcgtcgttgtagacgaacttgggcatttcccagtgaaagcggatcgccagcaggcgcagtaggaaaccgccgaacagggtgatgaggatcgactgctcgccgggcaattgcagatagatgcagagcatgtagcaccaggccgcagcgaacgagacgctggcatacagctcgcgacggaagatcagcggaatatcgttgcagaagatgtcccgcaggatgccgccgaacaccccggtaatcaccccgctgaccgatgccaccaccatgccgtggcccatttccagggcggtcatgcaaccgatcagggtgaacgccaccagccccacggcgtcgagcaccaggaacagcgaacgcaagtggcgcatcaagggcgcgatgaagatcgtcaccagggccgcaaccgaggtcaacaccaggtactccgggtgcttgacccaggtcagcgggtaatgccccagcagcacgtcacgcaccgaaccgccacccagggcagtgacgcaggcgatcaacaccaccccgaaccaatccatgccgcgacgaccggcggacaaggcgccagtcatggcttcggcggtaatggcaatcaggtaaagcatcagcagcatgatggcggtccttacaggaaggcgcgcagtctactcagttgctgtcggcaccaaaagggggcaccgcctggaattgctggagccccctggagcgatctatcgcgagcaagccttgcgcgaacccgtaggagcgaggcttgcccacgatggcgtcagaacagacaccagcgcaccatcagagcttgatgaagtgcttgcggtaatgctgcagttcggcgatcgactcgcggatgtcatccagggccaggtgggtactgcctttcttgaagctgtcgcgcacgtccggcgcccagcgggccgccagttccttgagggtggaaacgtcgaggttgcggtagtggaaatagctttccagtgccttcatatggcggtacaggaagcggcgatcctggcagatgctgttgccacagatcggcgacttgcccttgggcacccactgctccaggaaggcgatggtctgcgcttccgcttcagccatgctgatgcggctttcacgcacgcgctgggtcagccccgaaccgccgtgctggcgggtgttccactcatccatgccggcgagaacttcatcgctctggtggatggcgatgaccggaccttcagccaaggtattgagattgctatcggtgacgatggtggccatctcgatgatgacgtcggtatcagggttcagaccggtcatttccagatcgatccagatcagattctgcgggttttgcatgtgtgggctcctcggcgtagttgcgcagtttagcctagagggacctgccggcgtgctaaactcgcggccgttttacctaaccgccgcattatcgacacggaacaccaatggccaaacgccagctcaatcgtcgccaaaactggcgcatcgaaaagattcaaggcgaacgcgccgcccgcgccgccaaacgtgaatcctccgccgtggaagcactggaaggcggcgatctcggccccgaacagaccggcctggtgatcgcccacttcggtgtgcaggtcgaggtcgaggcgcgcgagggcgaactggccggccaggtgttccgctgccacttgcgggccaacctgccggcgctggtgaccggcgatcaggtggtctggcgtccgggcaaccagggtatcggcgtgatcgtcgcgcaactgccgcgccacaccgaactctgccgtcccgacagccgcggccagctcaagccggtagccgccaacgtcgacatgatcgtgatcgtcttcgccccgctgcccgaaccccatgccaacctgatcgaccgctacctggtagccgccgaacatgccggcatccgcccgctgctgctgctcaacaagttcgacctgatcgacgagcagaatgcccccgccctgaatgccttgctggcggtctatcgtcagctgggctacccggtgctggaagtttcggcgcaccacggcgacggcatggaacagctgcaagcgcagctggacggacggatcagcgtgttcgtcggccagtcgggcgtgggcaagtcgtcgctggtgaacagcctgctgccggaagtcgaaacccgcgtcgggcctttgtcggaactgtccggccagggcacccacaccaccaccaccgcgcgcctgttccacttcccgggcggcggcgaactgatcgactccccggggattcgcgaattcggcctgggccacgtcagccgcgccgatgtcgaagcgggtttcatcgagttcaacgacctgctgggcacctgccgtttccgcgactgcaagcacgaccgcgaaccgggctgcgccctgctcaaggccctggaagacggccggatccagcagcagcggatgaacagctatcgctcgatcatcgccagcctgccggacagcagctattaaaaaatataagtaactccgctcatatgcggagttacttatcagaccgatctgccaaactttgagaatagacagactcttgtaggaatcgtcccacgcaaaaacaagaagtatctgcttttatctcgtaaccttgtcaggtgcaattgttcaaatacattcaattcctcgccatgttgtcattcagataacgcggagacgcactgacattgggctatcgaggattcttccatgcaaacttaccacttattcatcagccactcctggagctactccgacaagcatgacaggctggtggagatgctcaacgaacaacccggcttcaagttcaaaaacttctccgtgccctggcaagaccctatcgtcggcgcgcatacagacaagcaacttgaggaggccatcgaaaaccagatacgtccctgctcggtcgtattgatcatggctggcatgtattccacctacagcaagtggatcaacaaagaaatcgcaattgctcagcgtctgggcaagaccatcatcgccatcaaaccgtttggcgccgagcggatttccacggtggtgcgcgatgctgcccatgccgaatgtgcgtggaataccaaaagcattgttagcgcaattcgtttgcatacggcggtgtagtatgcgcaaggcattgtttatcggaatcaataactacacacatataagtccgctgagcggctgcaataacgacgccattgccatggcctcaatactggaacgtcacgcaactggaaaaccaaacttcaaaaaccacgttttaacttccgcagaagaaaatctgacgcgtcgaatgctcgaagaaagtatcaaggagctgttttccggcgactgcaacgtcgcactgctgtactttgccggccatggcaacttcgataagagcatcgaagaaggcatgctgactccacaggactacaaaaccagccacgatggcattcgtatcagcgatatcctgcaatgggccaatgaagcagagaagatcaagaacaaggtgatcattctcgactgctgcgaatcaggcgctgccgcagaagcccgcggcctgaggggcggtgccagcgtcatcggcgaaggcatgaccattctgaccgcctgcaagaaagcccagcctgccatggagcagagcggccacggggtcttcaccgggctactgttgcaagccttgcacggcggcgccgccaacgtcctgggcgcgatcactcccggcagcctctattcgtttgtcgataacgccctggggggctgggaacagcggccggttttcaagaccaacgtctcccaattcatcgccctgcgcgaagtccctccactcatcccggaagaaatcctgcgcaagctgcccgactggtttcccgaagcccaatcggtattcgccctcgcccccagctatgaacccacggacccatcgttcgaccccgagcacggcgacattttttcccaactgcaaaagtgcaaccgacacagcctggtcgaaccggtggacgccgaacatatgtattacgccgccatcaactccacaggctgccgcctcaccgcactcggcgcctactatcgcgaactggcaatcaaaggacatttctgatgcctgtatttatcagctaccgacacaccgaccgtcctcaggccatgagcatcaacaaacgtctggaggacgccggcatcaaaacctacctcgatgtactggatctggaatcccagagcacagaagacatcaccgcagtcattacccgcaatatcaccgaatgcacgcatctgctggcagtggtgtcggacaggaccgcgcagtcctggtgggtaccattcgagatcggtgaggcgaccatcagtaatcgacggatctgctcgttcaagaccagcaccagcgaattaccggaatacctcgacaaatggccgaagctgaccaaagccagcgacatcgattttttcatcgaagcctaccgaaacgaatcggccctcaaacgctcgttctcgcttgagtccgtgaacggaagcgaatcccagcgtgccgtcaacagaaccaacgccgaccgtttccatacagaactcaaggccaggatccgtcgaggttattgagccttctgacgcccacaaaaaagccgacatttctgtcggcttttttgtcgatcactacttcggtggctcagccggttttggtgcggcgtcgtcgaagatattcaggcgttcgcgcagctcatgggccggcagcggctcctgctctggcggcaaggcgttcgggtcgaccggtacttcgcccggggcgccctggccctgggtcggtgccggggcctcgggagcgacttcgccttcgatcgcgcgctgggcctttttggtcagcaccacgatgtcgatacgccggttgatcgggttgaacgggtccttgcgatcgaacagcgacgacgaggcataccccaccacacgagccacctggccgtccggatagctgcccgccaccagcgcccgacgcgcggcgttggcacggttggccgaaagctcccagttgccgaaatcgccggtgcccgagtaaggcttggcatcggtgtgaccgctgatgctgatcttgttcggcaccgccttgatggtgtcggccatggccagcaggatgtcctcgaagtacggcttcaggcgcgcactgccggagtcgaacatcggccggttttccgaatcgatgatctggatacgcaggccgtccggagtgatctcgaacaggatctggtccttgaacttctgcaattgcgggttttcttcgaccttgttctgcagctcttgaagcaacagctccagacgctctctttccacctgctcggccatgctctcgacctgatcggtgtcgaccgtgaccttgtcgggctgcggctgcgacttgatctccgggttgagcgtgttttccggcgccagttcgggagaaccgcccaggtcgatgatgtagggcgtaccactttccgagaagccgatcgggtccttgaagtaaccggcgatggcgatcttctgttccggggtggcggtggacaacagccacagtaccaggaagaacgccatcatcgccgtggcgaagtcggcgaaggcgatcttccatgccccgccgtgatgcccgccggcaaagcgcttgacgcgcttgatgataatcggctgattattttccatggcttagcgaccgcgaaccgcttgttccagctcggcgaagctcggacggtgcgccgggtacaggaccttgcgcccgaactccacggccagcgagggcggcatgccggaagccgaggccaccagggaggccttgatggcttcgtagacgttcagctcttccttggcgtcgtgcgccagggaatgggccagcgggccgaagaagccataggccgcgagaataccgaagaaagtaccgaccagcgccgcacctacgtgcaggccgatggacttctggtcgccatcgcccagggatgccatggtcaccacgatacccagtaccgccgcaacgataccgaaacccggcatgccgtcggcgataccgttgaccgcatgggacggatgctcgaggtcttccttgaggctgaacagctccatgtcgaacagcccttccagctcgtggggagccatgttgccggaggacatgatgcgcaggtagtcacagatgaacgcggtcatgcgctcgtctttgagcacggatgggtacttggcgaaaatcgggctggcggcggcgtcttcgatatcgccctcgatcgccatcatgccttcgcggcggctcttgttgaggatctcgtagatcaggcccagcacttccaggtagaaggtctgggaaaaacgcgaaccgaacatccccaaggacttcttgagcacgtgcatggtcatgtagccagggttcgcctgcaggaatgcccccagcgcggcgccgccgataatcaagacctcgaaaggctggatcagggcggcaatcttgccgtgagaaagcacgtatccgccgagcacgctcgcgaacacgacgatgatgccgataattttagccataggtaggaaggtacttactgagtcgggttcaaggtcatattcggaagttcttaaaactcttcttctacttatcggcaaaactgcgccagactataggccgttaaggcgaaaagccagtttggcccgctctgggcgtgtttacagcagacgatgattgcgcccagccatgtctaatgaaacgacagtcccaactaccgccccccactccctcgaatcctggataaagctgcttgatgcggtccgcctgccggtgccgcaggccagccatgaccgagtctgcaaagccatcagggacaatcgcagctcattgcgcgacattgccgacctgatgcaggacagccccgcgctggccttgagcgtgattcgcgaagccaatcgccacacccacggcagcatgagcgagccggccgagaaccttgaggtcgccctcaaccgcctgggcctcgcgcgtaccgaagagttgctcgcccgcctgcccgcccagcccgaggaggagatcccggtcggactgcgccagttgcaactgatcagccagcacgcgacccaacaggccaacggctttttcgccgggcgcctggccaggctctggcaggacattcactggggcagcctgctgtttctctcgccgctgtggcccttggcgctgacctatccaaaactgctcgaagagtgggagctgcgtgtcgtccataaagccgaaccggcccaggaggtcgagcaggaactgttcggcgtcggcctgcttcagttgggccaggccctggtcgaggtctggcacttgccgatctgggtacagcaaggctaccgcctgctgatcgacgagcaggagcagttggtcaaggccctgcatatcgcccgggacaacgcccacccgttgcaccaacgacaatgcctggatgccgatccggccctgcagcgctggctgaaccagccggccaacagcgtgctgctggccaacgccctggccctgtcggcacaagagtcctggaccggcccgcactgcatgcgctggcaatacctgaccagcctgtatctgcaaatgccaatggacgaactgcaacaacagttgcaccagcaagccgcgcagagtgcccggcatcaccgcatgcccgacctgtggcatccggccgaggcgctgctctggccctgggaggcccggcgcgtgcatcgcggcgagctcccggttcccgcaccaaccgcagaagacctggccaagtggcgcaagcaatgcagcgaattgctggtggaacccagccgcttcagcaatgccatgcacctgaccacctttgcccgcgacgccctggtggcgtgcggcatgcgccgggtgatgctgctgatggtcgaccgcacgcggacccagttgcgcgtgcatcagatcgccgggctgcctgcgcccgccatgaacctggcattgacgatcaaccagagcagcgtgctgcaaaggctgctggacgctccggcgcaagtgcgcctgacgccgaccaacaacgcccagttctccgcccgcctgcccgccagcctgcgcacgctgtttcgtggcgagcacctgctgatgcgttcggtgcccagcaatggccgggtgatcatgctgatcgtcgccgaccaaggcggccaacccttctcggaaatctccgtacaggcgttcggcaagaccgcgcagtgcatcgaaaaggccctgcacagctttaccaaccgcagccgctgacgcttgcgctacaatccctccctttgtgccctggagacctcacatgcctgacttctctggcttgccgctggtgatcgagccgagcgacctgctccctcgcctcgacgcccgcgaactgattctggtggacctgaccagcgccgcccgctatgccgcggaccatatccccggcgcgcacttcgtcgaccccaagcgtacccagctcggtcaggcaccggcgccagggctgatgccgccacaggcagcccttgaagccctgttcggcgaactggggcataacccggacgcggtctacgtggtctatgacgacgaaggcggcggctgggccgggcgcttcatctggctgctggatgtcatcggccactcccgttaccactacctggacggcgggctgctggcctggctggcagacggcctgccggtctcgaacgaagtcccggcggccgtcggcggccctgtcgccctgaccctgcacgacgagccgaccgccacccgtgaatacctgcaaagccggcttggcgcggccgacctggcgatctgggatgctcgcggcccgctggagtactcgggggagaaagtcctcgccgccaagggtgggcacattcccggcgcgatcaacttcgagtggacggcaggcatggacccggcgcgcaacctgcggatccgcagcgacatgccgcagatcctcgaacagctcggcatcagcaaagacaaagaagtgatcacccactgccagactcaccatcgctctggcttcacctatctggtggccaaggcgctcggttatccgcgagtcaaaggctatgccggttcctggggcgaatggggcaaccaccctgacacgcccgtagagatttaaggtttttaaggacagttaatgaaaaagcgtttgtttatcctcagccagtacctgctgcctcaccacctgctgtcgcgcctggccggctgcattgccgagtgccgcgtgcgctggttcaagaatgccttcaccgcctggttcgccaagcgttatcaggtggacatgtcccaagcgctggtggaagacctgaccgcctatgagcacttcaacgccttcttcacccgcgccctgaaaaatggcgcccgcccgctggaccagaccccgggcgcgatcctcagcccagccgacggcgcggtcagccagctcggcccgatcgagcacggtcgggtattccaggccaagggccacagcttcagcgtgctggaactgctgggtggcgactcggccctggcagccccgttcatgggcggcgatttcgccaccatctacctgtcgccgaaggactaccaccgcgtgcacatgccactggccggcaccctgcgggaaatggtctacgtaccggggcggatcttctcggtcaaccagaccaccgcggaaaacgtgccggagctgttcgcccgcaacgagcgcgtggtatgcgttttcgataccgagcgcggcccgatggccgtggtattggtgggcgcgatgatcgtggcctcgatcgaaaccgtctgggccggcctggtgactccgcccaagcgcgaactgaagaccgtgcgctacgacgaagccgcccgcgcgccgatccacctggaaaagggcgccgaattgggccgcttcaagctgggttccaccgcgatcgtgctgttcgggccggagcaagtgcagtgggccgaagaactggcggccggctcgccagtgcagatgggccagggcatcggcctggccaaggcctgagccttgggcataaaaagccggacataaaaaacgccgcagatcgcggcgttttttttgccttggatttggctcagagctggccgtcgcgatcgcggaagcccagcagataaagcacgccatccaggcccagggtggaaatcgcctgcttggccgactgcttgaccagcggcttggcgcggaaggccacgcccaggccggcaatcgccagcatcggcaggtcgttggcgccgtcgccgaccgcgatggtctgctccaggcgcaaaccttccttggcggccagctcgcgcagcagatcggccttgcgctgggcgtcgacaatcggctcgaccgcgacaccggtcaccttgccgtcgaccacttccagctcgttggcgaatacgtagtcgatccccagcttggcctgcagctgcttggcgaagtaggtgaagccacccgagaggatcgcagtcttgtagcccaggcgcttgagttcggcgaacagggtctcggcaccctcggtcaggcgcagcgatgcgccgatggagtccagcaccttgatgtccaggccctggagcaaggccaggcgctccttgaagctggcgcggaaatccaactcgccagccatcgcccgctcggtgatttccgccacccggtcccccacgccggccgccttggccagttcgtcgatgacttccgcctcgatcagcgtcgagtccatgtcgaacaccgccaggcggcggttgcgacggaacagcgagtcttcctggaaggcgatatcgacgttcagctcctgggcgacgctgaggaactcggcacgcaatgcctgcggatcggccgcttcgccacgcacggagaactcgatgcaacccttgcccttgtcggccggggtgtccagcggcatgcgcccggagaggcgatcgatgtggtcgatgttcaagccgtacttggcggtgatcgaactgacgcgctgcaactgctcggccgtgaccttgcgagtcagcaaggtgacgatatggcgcttcttgccctggccaccgacccactgctggtaatcctcttcggaaaccggcgtgaaacggacctgctggtccagctcataggcggtgaacagaatgtccttgagcaccgacgaactctgctcgttgtccggaatttcaaccaggatgccgaacgacagagtgtcgtgaatcaccgcctgaccgatgtcgagaatgttcacaccaccctgggccagaacgccggtaatggccgcagtgagacccggacggtcctcaccagtgatgtttatcaggacgatttcgcgcaaggcgcacccccgcaggtggaaaaaaaccgcattctacccactttcagtgaccatcgggcacagccagcgctttgccggtctagggcctgtcgctatactgcgcctcaacttcacggacaaaagagccgagctcagtgaaccggcccacgccagttaaaaccgataacttcttcctgctgatcttccgtgcactgcgtcaccgccgtgtaccgattgcattgcgcattgccagccataacgtgatcctggtcgccctggccctggtgatctatgcctgcgtgatgggcctgcagttcaagcaggccatgcacgaacaggccgacgccctgggtcagagcctgaccacccagaccgcgacctcggccaccgagctgttggtgtccaacgacatcctcagcctcaacgtgctgctgaataacctgaccaagaacccgctggttgcccatgcggcgatctacagcgtggacaaccgcatcctcgccgaagccggtcagcgcccgaaaagcagcctgctgggtgaaaccgaaggcgtctaccagaccaagatcaccttccaggacgtgaccgcgggcaacctgcgcatcagcctggacatggaacaattccagcagccgatgaccatcagcctgcagagtatgggcattctcagcgcgatcctgctggctttggccctggccttgagcctgcgcctgggacggcacatctccacaccgctgatgcaactgcgggtctggctgcgggatatcgacgaaaacaccccggccacccagcgccaggacgagatcggcgacctggcgcgccagctgcacgccagcttcgcgccagagaaggtcgagccggaacccgaaccgcaagccgagatcgacgacaccgactacaacgacagcgaagacgcggaaccgaccttcgaggtgcgcaacctgcgtgacccgagcttcgatgaaagcgctccggtggccggcctcaagcccgcgccacggcacgtgatcaatgccgaagaagacctggccgacgatgaagacccgttcgccgaccttcgcgacagctcgtccaccgcgaccgctgccaagccgatcgtgaaacccacggtaccggcacagccgcagcacagtgcggtcctggccgtgcaactgggcgcccaggagcaactgcgccgtctgccccgcgcccgcctgacggaattgctggaacgttatcgcgactgcctcgaccaggccgcctcgctgtaccagagcgaactgcataccctgaacgacggcagcacgctgatgctgttccacagcgaagacagcggcgacgactacctgaccaacgccatctgctgtggcgagttgctgcgcgccctggggcatgccctgcaaatcgaagtggccgacagcggcatcaccctgcagctgcaactgggcctaacccttggcgaagagctgttcggcctgagccagatcgacctgctgttgaccgagaccgcccaggacgccctggcgctgtcccagcacagccgcaacctgctgctggtcgagcgcaagatcaacgatgacgccctgattcgtcagcgcgcgcgcatccgtccgatcgccagcccggaaggtgcctgctgcgtcgaacgcctgatggagccctacccatcgatgctggaacggcaactggcgcggatgcacgagacccgcgccaagctgtaagccagccgtccaacaaaaagcccgcagcgatgcgggcttttttgtggccgcggcacagtcgtcgcgagcaagccagtctcccctctgcaggagcgagcttgctcgcgatactccatcaagggcgcaccattacctcaggctcaacctgcccccccccccagaaacgacaaagcccgctgatcagcgggctttgtcctggaaccgcaacactcagaagcggaacacttccatatccgtgcggataggcgtggccattggaatcttcggctgcttctcctgctcggccggctttgccgccggcgcaggcgccgccttgcggggtacctcggctaccgtaggctgattggccagcggcttgagggcacccgagagctgctcggccaggcgttgcagcaatacgccctgggcctggacctgggacgcggtggtacccgcatgctgctcctgcagatgaacgatacggttgtcgcgaacctgcccacggcgatcgatcaggcgccattgcgcatcgagaaccgccggttgcgaggcgcccgaatccaggcgagtgatcgacagcagcacctgcacatccggagtgaaaccggtgctcgccggcgccagcactacacgctggctgtccagctggccggcgacctgacgcaacagcaactgatcgatatcggaagacaggctgccggcccagcgaccgtcggtcgaagcctgcaggctgccgtcgttctgacgttgcagcaaggtttcacgttgcaggtagtcggcaaccagtaccggccccagcaatacggccataccggcgctttgtgccggttgagctggacttccgctgtccagctgatacagcgacaccggctggtgtacgctgcaacccgccaggccaagaacgccagcgagcaagaaaacaagaggaaggcgcagagcagtcatcatcccatccaggtggcggccacaaggctagccacagtgtaaatactcaaaataaccctgaataacgctcagccacgccggcgcttgaaagcgcatatcatccgtgaatatgcgccatgactccagtgttgtagcgccgatctaccggttaaatcgcagatcgaacgctctaacccgcatcaattgagagtttctaccaataacgcatccactcgctggaagccccgtggcagtttgttcccccggcgaccgcgctcgcccttgtaatgttcgaggtcatcggccttgagcgacagggtacgttttccggcctgcagcaccagtgtcgcgccttccggcagtaccgcgatatcggtcacgtactcctcgcggctggccactcgctcacccggaatcccgatgatcttgttgcccttgcctttgcccaactgcggcaggtcgctgatcttgaacaccagcaaacgcccttcggtggtcaccgaagccagccagttctgttcacgatcgctcactggccgcggcaacagcaccttggcgttgttcggcaggctcaacaacgccttgccggccttgttcttggcttgcagatcctcgcccttgaccacgaagccgtaacccgcgtcggaggcgatcacgtacagcgcctcgtcgtccggcagcagtacgcattcgaaactggccccaggcggcggcgtcaggcgtccggtcagcggctcgccctggccacgggccgatggcagcgtatgcgccgccaccgaataactgcgcccggtggagtcgataaacaccgcgaactggttggagcgcccgatggccgaggtcttgaagccgtcgccagccttgtaggacagccccgtggcgtcgatatcatgccctttggcgcagcgtacccaacctttttccgacagaacgatggtgaccggctcggtcggcatcagctcgttttccgacagagccttggcctcggcgcgctcgacgatcggcgaacgacggtcgtcgccgtaggtttcggcgtcctgcagcaattcggtgcgcaccagcttcttcagcttggcttcgctgttgagcaaggcttgcagcttggcctgctccttgagcagttcgtcctgctcggcgcgcagcttcatctcttccagccgcgccaactgacgcaggcgggtatcgaggatgtagtcggcctgcacttcgctcagggcgaaacgctcgatcaatttggctcgcggctggtcctcggtacgaatgatgtggatcacttcatccaggttgaggtaggcgatcagcaagccgtccaacaggtgcaggcggcgctcgaccttgtccaggcggaactgcaggcggcggcgcaccgtcagtacgcggaactccagccattccaccagcagggcgcgcaggttcttcagttgcggcttgccgtccaggccgatgatgttgacgttgacccggtagctggattccagctcggtggtggcgaacagatgctgcatcagctcgtcgggatcgacccgattggaacgcggaatgatcacgatccggcatgggtgctcgtggtccgactcgtcgcgcaggtcggcaaccatcggcagcttcttggcctgcatctgcgcggcgatctgttccagcaccttggcgccggacacctggtgcggcagcgcggtgacgatgatgtcgccatcctcgatgcgatagacggcacgcatgcgcaccgaaccgcgaccggtttcatagattttcagcaggtcggcgcgcggcgtgatgatttccgcttcggtcggatagtccgggccctgaatgtgctcgcaaagctgttcgaccgtggccttgggctcatccagcaggcgcacgcaggccgtggcgacttcgcgcaggttgtgcggcggcacgtcagtggccatgcccacggcgataccggtggtgccattgagcaggatgttcggcaaacgtgccggcaataccaggggctcctgcagggtaccgtcgaagttcggcccccagtccgcggtgccctggcccagctcactgagcagcacttcggagtaacgcgacaggcgcgcttcggtataacgcatggcggcgaaggacttgggatcgtccggcgccccccagttaccctggccgtccaccagcgtgtagcgatagctgaaaggctgcgccatcagcaccatggcttcgtagcaggccgagtcgccgtgggggtggaacttacccagcacgtcaccgaccgtacgggcggacttcttgtacttggaatcggcatccagccccagctcactcatggcgtagacgatacgccgctgtaccggtttcaggccgtcgccgatatgcggcaaagcacggtccatgatcacgtacatggagtagttgaggtaggcattttcggtgaagtcagccagcgatcggcgttctacgccatccaggctgagatccagggagtcgctcatgcaggcctcatcagttcgttgtctggcgcagcagcaaagtgccgccgcgctgggtaaattcaagttttttcaaagcgctcatgcccagcaacacctgctcgccacccaggcctggcgcgaccagcgcacggacatcgcgcaggacgatatcgcccaattgcaggcggtcgaggcgggttcgataaccctcgctacgaccgttggcggtactcagggtcaccggtgcgcccttctccaggccaagacgctcggccagcccggacgggatcgacacatcggtcgctccggtatcgagcatgaaattcaccggctggccgttgatctggccgctggcgacgaaatgcccctggccgttgccgaccagtttcacttcgatgtaaccctcatgttgttgcgaagtgacgacagcattggggttctcctgacgctgttcccactcgccaaaaaaccgtgtcgccaggaacagcccggcgccccaggccagcaccagcagcacgcgcccggcacgtttacccggtggctgctggctcacgacttggcactccaaccaccctcgggcgcggcgaagcgccagacgatcgggcgtttttcaccgtcggcacgggctccggtgttgttatccacaccgatccaggcgccgtcggcatccaccaccagggcctcggtcaggccataggcctgtggataacgccggctttcctgcaacgcctcggcggcaaacgaccagcaacgctcgaccttggccgtcgacgcatcacgacgacagacctggaacgcattgcgctcgagggtgaacaacttgccctcgaacagcgacaggtcggcgaaatcccgggacaccgccttggccttgggcatctgcggcggctgcatttccagcccggcctcgctgagcagcacacagccaccgtcgcagtcccagacgctctgctggcgcttgatcaacaacagcccgcggcgctcgcgctcggcggccagccagatccggtcgccggccgggttgaccgccaggccttcgaacaaggcattgaagtgcagcaacataccgctggcccgcgcctcgcgcaccatgatcggcgaaatcttcagccaggcggccgaccccgtcggcggcagttgcaacactgcggcgtgggactcgctgaccacatacttgttgccggcgctgtcgcaggtaatgccctcgaaatccaggtcgccgccgcgcacgaacgacgcgacccaggtgcgcgaattcaagccccagggcaaaccgctgtccggcaccggcggtacgtcgatgcgcacggtttcggcctgccagacgcggtcgctggtatcgagccgatagatctggtcatcgtcgcggtcggagaccgtccacagctccttgccgcacaacgccagccccgacaggttgccgccacgcatgccgtccaccggatgctcggccagcagcctcaactcgggcaaggggtcggccatcgccgaggttgccaatagcagtaatgccagggcaaagcctctgcgcatcaggccagaacctcggccaggttgcctttggactccagccagctcttgcgatcgccggcgcgtttcttcgccagcagcatgtccatcatttccgaggtcgcggcgaagtcttcacccagggtcaactgcaccaggcgccgggtgttcgggtccatggtggtttcgcgcagttgcggcgggttcatttcacccaggcctttgaatcgggtgacctgcggcttgccacgcttcttctcggccaccaggcgatcgagaatgccatcgcgctcggcttcgtcgagggcgtagtagatctccttgcccaggtcgatacggtacagcggcggcatcgccacgtagacgtgaccggcatccaccagcgggcggaaatgctggacgaacagcgcgcagagcagcgtcgcgatgtgcaagccgtcggagtcggcgtcggcgaggatgcagatcttgccgtagcgcagctggctcatgtcctcggcacccgggtcgaccccgatggccacggcgatgttgtgcacttcctgactggccaggacttcgctgccgtcgacttcccaggtgttgaggatcttcccgcgcagcggcaggatcgcctggaactccttgtcccgcgcctgcttggccgaaccaccggcggaatcaccttccaccaggaacagctcggaacgcatcgggtcctggccggcgcaatccgccagcttgcctggcaatgccgggccctgggtaatgcgcttgcgctcaaccttcttgctggccttgaggcgacggccggcgttgctgatggccagctccgccagttgcatgcccaattccgggttggcgttgagccacaggctgaacgcgtccttgaccacgcccgaaacgaaggcggccgcctcgcgggacgacaggcgttccttggtctggccggagaactgcgcgtcctgcatcttcatcgacagaacgaaggcaatgcgctcccagacgtcttccggtgccagcttcaggccacgcggcagcaggttgcggaattcgcagaactcgcgcatggcgtccagcaggccctggcgcagaccgttgacgtgggtaccgccctgggcggtcgggatcaggttgacgtagctttcctgcacgctgtcgccgccctccggcaaccacagcagggcccagtccaccgcttccttgttaccggccaggctgccgcagaaaggctcggccggcaggcgttcgaattcgctgaccgcgtctaccagataggagcgcaggccgtcttcgtaatgccactcgaccttctcgccggtgcctttgtcttcgaagctgaccagcagccccgggcacaatacggccttggccttgagcacatgcttgaggcggctgacggagaatttcggcgaatcgaagtatttcggatccggggcgaaatacacgctggtcccggtattgcgcttgccgacgctgccgaccacttccagttcggtggccttgaagccgtcggcgaaggtcatctggtattcgttgccatcacgcttgacccgcacccgcacctgggtcgacaaggcgttgaccacggaaatacccaccccgtgcagaccgccggagaactggtagttcttgttggagaacttgccacccgcatggagcttggtgaggatcagctcgacgccggacacgccctcttcggggtgaatgtccactggcatgccgcgaccgtcatcggacacttccagggaatggtcggcatgcaggatgacctggatcgacttcgcgtgccccgccagggcttcgtcgacactgttgtcgatgacttcctgggcgaggtggttcggccgggtggtgtcggtgtacatgcccgggcgtttgcgcaccgggtcgaggcccgagaggacttcgatggcgtctgcgttataagagctagcgctgggagtggccatggggtctcgtcgttagtcgttcaatgaaatagaagcgagggttcacagcgaggtgaaatcgatcgcctggtactgatccgggccgatgccggcaaaattcaacaacgccggcaattgtccggcaaaaccctggaaactatggtcgccgccggcctggatgcgcaaggcacaggctcggtaatacagctgggcgctgcgatagtccagcgtctcgtcacctgtctgcagccagacctggaaccgctgcgggtcctggggcgccggcacttccagctcggccagggccgtcacgtggtcgtgggtcagttcccaggtttccccggtatagaggttggtctgcgtgcccagaaagccgtcgaacatccggtgcggactgaccgcggggttgatcagcagggctttcaggccgtgacgctcggcaaggtgagtcgcatagtagccgccgagagagctgccgaccagcagcggccgtccgagttcggcaatcgcctgctccaactggccaatggcctcgcgtggatgatgatgcaaggccggcacccgcagctgctcaccgcggccgatcgcctccatgacagcgatcaactggctggctttcttcgacgccggtgcgctgttgaagccgtggatatacaggatcgaaccggacatgcgcactccctttgcatcgtgcaaaaaggcgcagtttacagggtgtatcgccgcttgacttgtgttcaggtgtatccctttgtcctgccgccgccaactgcggctccgggccggaatcagtagccgtcgctgccgtaatcggcctcgaagtcgaagccggtgacccgctcgacaccggtttccaggcgcccgtcgggcagcaggcgcagccagcgataacccggcgcggtctcgccgaccttgaaatcctcgctgcccggttcgaactggatgcaggtcgagggcgacgccagcaggcgcaaaggcccttgctggcggtcgatttcctgatgcacatggccccagagcaccgcgcgcgcctgtggaaagcgctccagcacggcgaacagcgcgtgcggattgcgcagcccgatgggctccatccaggcgcacccgatggagaccggatgatggtgcaggcatatcaggtgatggcgttcgggggcttcgctcagggcactggcgagcagctgcaattgatcgtcctgcagatagcccggcaccgaaccgggtacggccgagtcgagcagggtgatccgccagttgccgatgtccaccaccggtgccagcaacgaactctgggtcgccgcctgcgccatgatttgcggctcgtcgtggttgccgggaatccagcgcgccggcgccggaatctgccgggtcatgtcacgaaacagctgataggactccagcgtaccgtcctgggacaggtcgcccgtggccagcatcaggtcgatccgcggttgctgttccagcaccaggtcgatcacccgctgcaggctgtcgcgggtattcatacccaacagcgtgccgtccgcttcggcgaacagatggctgtcggacaactgcaccagcaacacgggatcgtcggtggtcagagtggatacgctcggcaaggcggcctcccagggcgtgtcacgggaagtgaggaatgggggcaattatgctgggggaagctcaaaagaggaaaccggcgaaccggacgcagttcacatctaccgcacggcctcgaactcatgaccgcaagccaggcagtggctcagccattcaccgagaaacacattgagctgggccttctcgtccggctggtgcatgaaggcattcggatacggatagatgccacgaaagcgccgagcgtgctcggcactgacgacctcggccatgcgcgcgtcgtggtagacctggacctccagctgcggcaccggcagccagggcaggctgtgctcctgacgcacctgcagggtggtggtataggggcaggccagcagcacttccagcgccagaacgccaagcatctggtcgccctgggtcaccgcgatccgccgcgccaccggctggttgcgcatgtcgggcaacaggcgcatcagccgggcatagttcgcctcgcaggacgcttgcagccccacgagatcgacccgatagcgatcgcgtactttgtttacgaccataaccccctcacttcaacgcggttcaaagccagccattgcaaggcaataatgctcgccgcgttggaaatccgcccatcccttaccgcctgcagtgcgtcttcgaaagcccagaccgacacacggatatcctccgcctcttcctccagtccgtgcaggccaccggcaccgctgctgtcgcagcgccccaggtacagatgcacgaactcggtgctgccccccggcgacgggaaatactggatcatcggccacagcgcggagaatgtcagtccagcttcctcctgcgcctcgcggtgagcaacttcttccggctgctcgtccttgtcgatcagaccggcgaccagctcgatcaaccagggagtcgcggtttttcccatggcgccgacgcgaaactgctcgatcaacaccacttcatcgcgttgcggatcgtacggcagcacgcagacagcatcatgacggacaaagatttcacgactgatctcgcgccccatgccaccggcgaacagttcgtggcgcaggtgcacacggtcgagctgataaaaaccctggaagcatttctcgcgccgaacgatatcgacagtggtcggcgtggtgttggcaaagtccgtcatagcaatcctcgtatcctgctgtccgattcgaggctccccctcgatatcgcgccatcctaacgcgctgctgaccgatgatgcagcccctttgccatcagcgggatagacggcaagggggcaaacctaatctaattgcctctattgagcttagtggcgaactgattgccccgcaggcagtcgaagccggtaacttttgcctacctctggtttatcaaggacgcacatgtcgcttcttaaaatcgcctccgtggcttgcctggccctgaccctgggcgcctgccaaagcctgttccaacccagctatcaaaagcccctgcaaagcaccagcgacaagtcggaacagatcaagcccggctgcagcaatcaggattgcccgctggtgaacatcgacaccgtgcacttcgccgacgagccgcagctggatgcgctgattgaaaagcgcctgctgcaaatgacccgcaccaccgcggaccaggccgtgccagcgacgctgagcgcctatcgggagaagttcctgcgcgaggccgacagccgcaacagcatgtacctgcaagccaaggtacgcgaacagcatgacggcctggtgatcatcgaactggccagctacctggacaccggcggcgcccacggtacacccggtcgcggcttcatcaactactcccgcgagctgcacaaggagctgaccctgtccgacatgctgcgcccaggccaggaagccgcgttctggaaggccgtccaggtggcccacaacagctggctgatcagcaccaagctggaccaggaaccggagttcatcaagagctggccgttccagaaaaccccgaacgtggcgctgacctacggcggcgtgatcctcaagtacaacgtgtcggtaatcgcgccttacgcgctgggccacatcgaactgaagattccttacaaccgcctgaacggaattctcaagcccgagctgtttcctggccgcagctgaaggcccgccccagcagcccttgcagcagcaagctgcaagcagcaagctgcaagctgcaagctgcaagctgcaagctgcaagctgcaagctgcaagctgcaagctgcaagaaaaagcagaaccgcttttgcctttaacttgcagcttgccgcttgccgcttgccgcttaaaccttcttgtacagctggctgccttcctgcttgaatcgctcggcctgctccgccagccccttggcgacatccacgtccaccgcttcgatgcgctggttagccgcgtactcacggacctcctgggtgattttcatcgagcagaacttcggcccgcacatggagcagaagtgcgcgaccttggccgagtccttgggcagggtctcgtcgtggtaggcgcgcgcggtgtccgggtcgaggccgaggttgaactggtcttcccagcggaactcgaagcgcgccttggacagtgcattgtcacggatctgtgcgcccgggtggccttttgcgagatccgcagcatgggcggcgatcttgtaggtgatgatcccggtcttcacgtcatccttgttcggcaggcccaggtgttccttcggcgtcacgtagcagagcatggcgcagccgaaccagccgatcatcgccgcgccgataccggaggtgatgtggtcgtagcccggggcgatgtcggtggtcagcgggccgagggtgtagaacggcgcctcgtcgcagcactccagctgcttgtccatgttctctttgatcagttgcatcggcacgtggccggggccttcgatcatgcactgcacgtcatgcttccaggcaatcttggtcagttcgccgagggtttccagctcaccgaactgcgcttcgtcgttggcgtcggcgatcgaacccggacgcaggccgtcgcccagcgagaagctgacgtcgtaggccttcatgatttcgcagatttcgtcgaaatgggtgtagaggaaattttccttgtgatgcgccaggcaccacttggccatgatcgaaccgccacgagagacgattccggtcacgcgcttggcggtcagcggcacatagcgcagtagcacgccggcgtggatggtgaagtagtcgacgccctgctccgcctgctcgatcagggtgtcgcggaacagctcccaggtcaggtcttcggccacgccgttgaccttctccagcgcctggtagatcggcacggtaccgatcggcactggcgagttgcggatgatccactcgcgggtttcatggatgtgcttgccggtggacaggtccatgaccgtgtccgaaccccagcggatgccccaggtcagtttcgccacttcttcttcgatggacgagcccagggcgctgttgccgatgttgccgttgatcttcaccaggaagttgcggccgatgatcatcggttccagttcgacgtggttgatgttggccggaatgatcgcgcgaccgcgggcgatttcctcacggacgaactcgggggtgatttctttcgggatgctggcgccgaagctgtggccggcatgctgctgatcgagcagacccgcggcgcgagcctcttgcagcttcatgttttcgcggatggcgacgtattccatctcggcggtgatgatgcccttgcgcgcgtagtgcatctggctgacgttggccccggccttggcccggcgcgggttgttgacgtgggtgaagcgcagcttggtcagctcgggatcggcgaggcgctcctggccgaagttggagctcaggccgggcaggcgctcggtgtcgccacggtcgtcgatccaggccgagcgtacatcgcccaggcctttgcgcacgtcgatcaccacgttggggtcggtgtacgggccggaggtgtcatagacggtgactggcgcgttgatctcgccgccgaagtcggtcggggtcacgtcgaggctgatttcgcgcatcggcacgcgaatgtccgggcgcgaaccctggacatagattttttgcgagcgggtaaagggctgaaccgactgctcatcgaccttggccgattcactaaggtgggtagcgttttttaattttgtagtcatcacgggctctccagacagcatccaggcagtggatttttgtcggagcgaacctgtaacgaacggacgcaaccatggctggagccagaggcgaaaaccagctggtgcagtgcttggtgctcgaggggtgttcgattgtcgaacaacatcccggacgaagcacaagaggactcgccgggtgacgagaaatcttgttccctacgcaggcgctaacctgatcaggttcaacgggatccggattatccgatctcagcctcatagcaaggcaccccgacaagaacccggccagtctagacaaagccggtgcagaacgccaaccccacggcaaacagcgtgatgaatggcgtaaatgcaggattgttgcccttcgcaggcgcatctacactcgctcaggttgcgtcgaaccttgacgctgcacaggccgagacttagccttggcgccagaattatcctcgtaatatcaactctagggatcgccgaatgctgcgcaaactctcactggccatcgccgtgtcttgtgcgtccaatggaatggcctgggcagtagaagcgcccctgaccaccaaaaccgacctggtcagcgtctaccaggaggcggtagacaacaacgccgacctcgccgccgcccgcgccgattacgacgcacgcaaggaagtggtgccgcaggctcgcgccgggctcttgcccaacctctcggccggtgccgacctgaacaacacccggaccaagttcgacgagccgtcgatgaccgccacccgcagcggcaccgtgtaccaggcgaccctggcccagccgattttccgcgccgaccgctggttccagctgcaagcggccaaggacgtcaacgaacaagccgcgctggaactctcggccaccgagcagaacctgatcctgcaaagcgccgagagctacttctcggtcctgcgcgcccaggacaacctggcctcgaccaaggccgaagaggccgccttcaagcgtcagctcgaccagtccaacgaacgcttcgacgtcggcctgtcggacaagaccgacgtcctgcaatcccaggccagctacgacaccgcgcgggccaaccggatcctcgcccaacgccaggtcgatgacgccttcgaagccctgatcaccctgaccaaccgtcagtacaacgcgatccagggcatcgtccacagcctgccggtgctggcgccggccccgaatgacgccaaggcctgggtcgataccgcggccaagcagaacctcaacctgctggccagcaactacgcagtcagcgccgccgaggaaaccctcaagcagcgcaaggccggccacgccccgaccctcgacgcggtggcgcaatacaagaaaggcgacaacgacgccctcggcttcagcaacccggccccactgggccagcgttacggcagtgacgtcgaacaacgcagcatcggcctgcaactgagcattccgatctacagcggcggcctgaccagttcccaggtccgcgagtcctactcgcgcctgacccagagcgagcagcgccgtgaagccctgcggcgccaggtggtggaaaacacccgcaacctgcaccgcgcggtgaacaccgatgtcgagcaggtccaggcccggcgccagtcgatcatctccaaccagagcgccgtggaagccacggaaatcggctaccaggtcggcacgcgcaatatcgtcgacgtgctcgatgcccagcgccagctgtacacctcggtgcgcaactacaacaacagccgctacgactacatcctcgacaacctgcgcctcaagcaagccgccggcaccctcaatccgggcgatctgcaggacctgtcgcgctacctgaaagccgactacaacccggaccgcgacttcctgccgccggacctggccaaggccgcggcggaacagctcaaggcccggccggggcagtaacctgtagccgctgccgcaagctgcgatcgaccggaacagtcgtaaaaaaggccaccgccattcaacagaatcgcggtggcctttttgcctgtccttcggacaggatcgcagcctgcggcagcggctatagcaagcgatccaacccgtcgagcagacgctgcagggcgccctgattgctgcgcatcacccgcagtccggcatcggccatcttctgcgcatcccgaggcaactcgaacaggcgctgcaccgccaccgccaggccatgggcatcgtccacttcctgcagggcgcccgcctcgcgcagcatcgccgcgatctccaggaagttgaacaggtgcggcccgctcagcaccggcttggccagggccgccggctccagcaggttgtgcccgccgttgggcaccaggctaccgccgacaaaggcgctgtccgccagggcatagagaaacagcagctcgcccatggtgtcgcccagcagcaccgaggtgctggcggtgaccggctcggcgctcgagcggcgaatggtcgcgaagccctgctgccggcacagctcgaacaccgggttgaagcgctccggatgacgcggcaccaggatcagcaaggcatccgggtggttggccagcagttggcgatgggcatccagcaccacggcgtcttcgccttcatgggtactagcggcgatccacaccgggcgctcgccggcttgccattgctcgcgcagctcgctggcgcgcaccagcagttgtgggtcgatgctcaggtcgaacttgatcgagcccgtcacctcgactgtttgcgggcgagcgcccagctggcgaaaacgctcggcctcggcctcggtctgcaccgcgaacaggctcatttcagcgagcatcggtgcggtcagcttggcaaaacgcccataaccccgggccgagcgctccgacaaccgcccattggccagcgccaccggaatcccgcgcttggcgcactggtgaatgtggttgggccacagctcggtttccatgatcaccgccagcttcggccggacccgatcgagaaaacgcgcggcggcgcaaggcaagtcgtaaggcaggtagcagtgctggatgcgcggctcgttggcgaacagtgcctggatacgttccgagcccgtgggggtcatgcaggtgaccgtgatcggcagttgtggataacgcgccagcaaggcacggatcatcggcgcggcggcgatgctctcgcccaccgacaccgcgtgcacccagatcccgcccggctgcatcgccggcagcccccaggaaaaacgttcgccaatccgcctagcataagccggcgccttgcgcgcccgcagccacagacgaatcgccaccaatggcagccccaggtaaaacagcgcggtgtacagagttctattcatggcggcggagtttatcggctttttcagccaatcgcccgcaagtgcacggcaaaacgctccgccagccaatgcgccgccggccccaggggttcatcgcggcgccagaccagttccaccaccagtgccggtggggtccattcgctggccaactcgaccatctggttctgataggccgggtactgcaccacatgccgcggcagccaggcccagcccaggccgcgcatcagcagctcggccatcgcgtagaagctgtcggcgcgccagacttgcgggctgacctgctcgccactggggtaagtgctcaactgcggggaaatcaacaactgtcgatgccgccccagttgctggcgatccacctgtttctcgccggccaacgggtgcccgaccgcgcacacagtgaccatctcgacgctacccagggcccgtcgttcaagggcctcggacatctgttcatggtgaaacagcaaaccgaggtcggcccgacgctccagcagcttgcgcgccacatcaccctgggcgctgctggccagttgaacctcaagactggggaaacgctcggacaacgcctcaaggctatcgagcaccggctggaaaggcatcgcctcgtccagggccagccgcaagcgcgcctcctcaccccgcatcaacgccagcgcccgcccgttcaagcgctcgcattggcgcagcacttcccgcgcctctgcaagcaaggcacgacccgcctcggtgagtttcggttggcgaccgctgctgcgctcgaacaagagcacgccgagatcggcctcgagcagcgcaatcgcgctgctgaccgccgattgcgccttgtgctggtcacgggccaccgcggaaaacgaacgttgctcggcgacgctgacgaacagccgcatctgctccagattccactgcacattcataaggcaacccatcttcaaaacagataggtaatgactttatcccatctgcacaatctctagaatgccgacctcatcaagcaagcccaaacgcgaggactctcccatgaacgcttacacctacctggccatcgccatctgcgccgaagtgatcgccactgtttcgatgaaagcggtcaaaggcctgagcactcccctgccgctgctgctgatcatcgtcggttacggcgtggccttctggatgctgaccctggtggtgcgcaccgtgccggtgggcgtggcttacgcggtctgggccggcatgggcattgtcatggtcagcgtggctgcactgtttctctacggacagaaactggatatcccggcgatgctcggcatggccctgatcgtcctgggcgtggtggtgatccagctgttttccaagactgccgggcattagaaaagcagcggcaagctaccagcttcaagcggcaagagtgagcgtcacgcttgcagcttgaagcttgaggcttgaaacttgcgccttcgatttgttctccgaggtcgctgcatgccatccgttatttccaccgacgtgctgattgtcggcgccggagtcgccggcctctggctgaacgcccgcctgcgtcgccagggcttttccaccgtgctggtggagagcgccagcctcggcggcggacaaagcgtcaagtctcagggaatcattcacggcggcgccaaatatgccctgcacggcgccctgaccggcgcctcggaagccatcgccgacatgccgcgccgctggcgcgaggccctggccggcaacggcgagctggacctgtccggtgtgcgcctgctgtccgaggcccattacctgtggtcccccggcaccctggccggcaacctcaccagctttttcgccagcaaggctgtgcggggccgtgtcgatcaggtcaagggcgaccagttgccgccggccctgcaggaccgccgcttcaagggcaaggtgtatcgcctggccgagctggtggtggacgtgccgagcctgatcgggcgcctggccgaactgggcggcgatagcctgctggccgggcagaagatcgaacccctgctggaaaacggacaattgctgggcctgcgggtcgatgagcgggaaatccgcgcgcaacgcatcgtgctcagcgccggcgccggcaatgccgagttgctgagcagcctcggcctgagccagccggccatgcaacgccggccattgcacatggtgatcgtcaagggcccgagcctgaaaccgctgtacgcccactgcctgggcggcgggccgaagccgcggatcaccgtgaccacccatccggcggccgacggccagtgggtctggtacctcggcggcgacatcgccgaagccgaaggcgtggcgcgcgagccggcggcgcagatcgcggccgcccagaaagaactcggcaacctgttgccatgggtcgatctcagccaggcgcaatgggccactctgcgggtggaccgcgccgagcccgcgcagtcgggcctgacccgtccggacaatgcctttctcgccgaacaggaccgcctgctggtcggctggccgaccaagctggccctggccccggacttcgccgaccgggtgttcgccgccctcgagcgtgacggtatcaagccgggccccgcgactccgttgccaacgctgccgaaacccgccatcgcgcaaccggcctgggagcaactgctgccatgagccaagcgaccctgcacgacctgcatcgccccttcggcagcagcgggctgctggtctccccactcggcctgggcaccgtgaagctcgggcgcgaccaaggggtgaagtaccccaacggcttccagattccggatgacgccgaagcccgcatgctgctcaagctgacccgcgacctgggcatcaacctgatcgacaccgcgccggcctatggccgcagcgaggagcgcctgggcccgctgctgcgcgggcaacgccaggactgggtgattgtcagcaaggtgggcgaagagttcgagaacggcctgtcgcgccatgatttcagcgccgcgcatacccgcttgtcggtggaacgcagcctgcagcgcctggaaaccgacttcatcgacctggtgctggtgcattccgatggcaatgacctgcacatccttgagcagtgcgaggtctaccagacgctggccgagctcaagcaggaaggcaagatccgtggcttcggcttctccgggaaaaccgtcgaagggggcctcaaggccctggaacaaggcgactgcgccatggtcacctacaatctgaacgaacagaacgagcgagccgtcatcgattacgccgcagtccacggcaagggcattctggtgaaaaaagccctggccagcggccatgtgtgcctgagccccggtgtcgacccggtgcgcgccagcttcgaactgctgttcgatcaaccgggcgtcgccagtgctattgtcgggaccatcaatccgttgcacctggcccataatgtcgccactgtcgcgcaggtgttgcgcaagaactgatgccgcccacgcggccgaccccgacgcaagaaggagccgacatgccgcgtacgctcataagaaagaaccccagcaacttcaagaccctgccgctgttcgtcgaagcgacgcccgaaggcctcagctaccagagcgtcggcatgccgctgaactttgcgcagaccctgcagcgccggcgcccggtcgcggtggccgacgccgagcgcttcgccctggagctggccaacctcggcgtctcggtacgcctgaccctgcattggcagaaccgcgactattgggtgctggtgcgccagcgccggcaggaccgcggcgacgtggtgctcaagctgatttccggctacgtcccggcccatgagctgaacctgccgctgcataccgccatccaggaaatcgccgaagaatgcctgctggaaaccccggaaggctggctcggcgggcgcttcaacgacacctggctgcccgccccctactcgaccgccctgcattatcgcgaggccctgccctttcgcctgacgccgctgtcgggcgcggcacgcccggtacgctgcgccaacctgcagttgctggaacggccgcgggcctatgtgcacctgcccaccgcttcgctgcagctgatttatgacctgcgcctggacgtgccgaaagaagccaagtccctgagcctgttccatgtcgacgaacgcctggaaggcgaccaactggtggcgcgcctggatcgcaagcgcccggacctttacctgatgccactcaaggacggtcagccctgcgccgagctctatacgttgaagaaggatcagttgcacccggcgagcacccgcggcctgtatctggccgaaagcttcgcccggcagcaaggctggctggtgcgtgacgagcggattcgctggaaggactggctgaagcagcagggattgagcgcgccggagaaggactccaaactccagcgtcttaccggcaaggcacgacagatattgcgcaagatggtaccgaccaagaccagccggcaacgttgagcgcctcaccgcccactccagctttcgcgggagcgggcgggttggcggcaagccttactcggtcttgcggatcttctcgactatggccgtggtggaactgttctccaccaggcccagcaccttcaccgtaccgccataagccgtgacgatatcggcgccgaccacctggtcgaccgagtaatccccgcctttgaccaacacgtccggcttgacctgggccagcaggttttccggcgtaccctcggggaaactgatgacccaatccaccgcgcccaggccggccagtaccgccatgcgccggtcgacgctgttgatcggacggcccggccctttcaggcgactgaccgaggcatcgtcgttgatcgccacgatcaggcgatcgccttgcgcccgcgcctgctcgaggtaagtcacatggccggcatggaggatgtcgaagcagccgttggtgaagacgatcttctctttgtgcgcacgcgcatcgtcgatcgccagcaacagctggtcgaggctcagcacaccgcgctcggaaccttcttcacgctggatcgcgcgacgcagctccggtgcgctgatggctgcggtacccagcttgccgaccacgatgccggcggccaggttggccagggccaccgcgtgcggcagctcttcacccgccgcgattgccgccgccagggtggaaatcacggtatcgccggcaccggtgacgtcgaacacttcacgggcccgggccggcaagtgcagcgccgggtgatcgggacgcagcagggtcatgccgtgttcgccacgggtcaccagcaaggcacccagctccaggtcgtgcatcagcttcgcgcctttgctgaccaggtcatgctcgtcgatgcaaccgccgactatggtttcgaactcgctgaggttcggggtgatcaggctggcgccgcggtaaatcgaaaagtccttgcctttcgggtccgccaacaccgggatgccacgggcacgcgcggcctggatcagcgcctgatgattcctcagggctcccttgccgtagtcggacaacaccagcaccttgatgccgtccagcaaccggtcgacttcagcgcccaacgccagggcgtcggtggcgaaaggttcttcgaaatcgatacgcaacagttgctggtgccggctcatgacccgcagcttgacgatggtcggctggtgggcaatgcgttggaacaaggcgcgtacgcccgccccctcaagactgttggagagactgtcggcagcctcgtcgtcgccggtgacgccaaccagcgaggccggtgcgccgagcgcggcaatgttcaaggcaacgttcgcggcaccgcccgggcggtcctcgatttgctcgaccttgactaccggtaccggcgcctcaggggaaatccgtgaggtaccaccatgccagtaacggtcgagcatgacatcgccgaccaccaagacaggggcttgatcgaatcgcggcatggacaacttcatggagcaacccacatacaaaatgaacaggggcgcgatattaacacagggtgaacgctgcctagttctaccgctgcacgagtattcgcgatcgccccaaactgttcatttattgagcaaaagcgccataagccggtctgtcgcgcaggccaatccaaccgtttcggtatcgatctcgcagtcaggatccaatggcgcttcataggggctgtcgagcccggtgaagtcccggatacgcccttcgctcgccgcctgatagaggccttgattcagtcgacgattgaggctggaaccataacaagcacggggcgctggattacttaggcttggtcaagactgtaaggggcgggatacaaagaccgccggcgcattgcacgccggggccgttccagggtgggcagtgcccaccctggcgttggctcaggcaatgccttcggaagcaggctcgtccaggcccatggcatgcaggcgcgagtagtagccgttctgcgccagcaggtcgacatgagtaccgcgctcgacgatccgcccctgatccatgaccagaatcaggtcggccttctcgatggtcgacaggcggtgtgcgatcaccagggtggtgcgccccttcatcaccttgtccagggccgcctggatatgccgctcggactcggtatccagggccgaggtggcttcgtcgagaatcagcaacggcgcattcttcaacagggcccgggcaatcgccagacgctggcgctgaccgccggagagcagcacgccgttctcgccgacctgggtgtccaggccttcgggcaactgcgaaatgaagtccatggcataggcatccgtcgccgccttctcgatgtcttcccgcggcgccccggccaggtcgccataggcaatgttggcggccacgctgtcgttgaacagggtcacatgctgggtcacctgggccacatgccggcgcaggttgcgcaggcggtaatcctcgatctccacgtcatcgaggagaatctgccccgtttcgtggtgatagaagcgcggaatcaggctggccagggtcgacttgccgctgccggagcggccgaccagcgcgatcatctgcccgggagccgcgcaaaagctgatgtccttcagcacttcccggtcggtgcccggataggtgaagctcaggttgcgcacgtccaggcgaccctcgatgcgttcacgctcgatctgtccccgatcgacttcaggctcgacgtccagctgttcgaagatgctttccgcgcccgccacgcctttctggatggtcgaactgacttccgagagctggcgaatcggcttgggcagcaggcccgccgcggtgatgtaggccaccaggtcgcccgcggtggcatcgccacgcaggaacagcaccaggaacatcagcaccgccatggcggagtagatcaccaactgcagcatcggcgtgtagaccgcaccagtcttggtcatgcgcagctgtttgtcggtgttgctctggctggcgtcgacgaaacgctgctgctcgtagctttcgccaccgaagctgcgaaccacgcgatagccttgaatggtctcggaggccacatgggtcacatcgcccatcgccacctggatcttcttgctctgcttgcggaatttcttgctggtgctgccaaccatgaccgcaatcaacggcaggatcgccagcatcaccagggtcagcttccagttcatccacaacaggtagacgaacaggaacactaccgtcaggccttcacgaatcaccaccttgatggcgtcggtggcggcaccggtgaccatggtgacgttgaaggtgatgcgggaaatcagatgcccggagttatgggtatcgaaatagcggttcggcaggaccagcagcttgttgaacagctcgacccgcaggtcatgcaccagccccagggaaaccttcgccagatagtagttgccgaggaaagagccgagcccctgccacgccgcaatcaggatgatcagcagcggcaccgccatcaatagctgcaagtcgcgcagatagggaacgttggggaagagcaccgcttcgggattgctcaagccgtcgacgaaatatttgagaatgcccgccagcatcggctgggtggatgcaaatatcacgaagcccacgatactcagcaggaaaatgcctatgtagggttttacataccccaagagccgaaaatagattttcaggctggaatcctgttccgctttgagcggtgcatcactcatcgtcgagctcactgtttaggaggaacgcgggattttatcacagcctgtgtgaccgccccgtgcccagaccaaaacagtggccagaccgatcggcagccaactgatgaaccattcggcgcgaggggttccggtcaggctggcggcatcgaactgcatggccaggaaggagaacagccagatcccgatgacgccccggccatacagtgtttcacgggcgcgccaggcttcgcgcaggacggcaaaccaggccacgacccagagcaacagcccggggatacccagttcaatggcaatgtgggtgaacaggttgtgggcatggtcgaatgtcaaaccgtcgaccagcacgtcataactcgagcccaggccgaggcctgtccatggatgttcggcgatcatctgcagactggccatcagaatctgcgggcggaaggaaacgccacgtgccatgatcaaaggttcgagaaaccagaacgccagcatcgccagcaacaatgccgcggccgcgaacatacggctgagtcggtcgcggcaccagatcggcatcgccaacacggtcaggaacagagccagggcagcaccgcggctctggcacaacacgacgaacgcgccgagcagcgccaacgctaccagccataccgtttgaagagaacgagtgcgcggcatccaatgcagcaaccagatagcagtgaggccaatgacataaccgcccaggatcggatggcccaactcacccagcccttccaggcgtccccaccagacatttccatgaatccagtagaactggataatggacagtaaagccgtcaccgcgagccctatgccgccccactgcatgacagtaatcacccgctccgggcgggcattggcgaaaatcgggaagaacagcaggaacaccgcgatgtacagcaagcgcttggcctcgcgtgacgggtccgccgcttgcgtccatgtcaggctgatcagcccccatatcgccagccccagcaatgccaggccaagccagcgctgagcacgccaccactcgatcaggcgctcacgcgcggaccaggccagaatcattgccggcaaccacaagaaggccaccagcccctgctggtagagtttgttggtgggcgccagtgcgatggctagcaaaaaccatagcaacccgactgtcatccatacttgcgcccaacgtgtggcctgcatctactcgctcctaaatggatcacccagccaacccggcatggttaaaacaacaacttttcggcatcattgcccgtcactgtgcccgccacttcgacaaggcttcctacgatgcaatgctcccggcttccccaagccactttgaatcagatgattgaaggcgccagaattctggaggccgacagttacggcccgaaagtctacctgttgcaggatgggaatattctgaaactgttccgtcgcaagcgtcttttttcatccgccctgtttcggccctattcgaagcgtttcatcgacaacgccgcacgcctggaacaactcggcgttcccaccctgcaggttctggacttctaccgcctggaacaatccggcatgaccgcggtgctctaccgcccgctaccaggcgaaaccctgcgccaggtcgccagcaaggaaggtttcgactggcaacagaccttgccggccttggtcgagctgattcgtagcctgcatacctcggggatttactttcgctcgctgcacctgggcaacatcgtcatcaccccggataaccgcttcggcctgatcgatgtggccgatatgcgcttcttccgcgggccattgccgcgccatttgatcaaacgcaacctgcaacacttcgcccgctatattgcccgggagaagctgaatgggagctttccgctgcaagcattggaacaggccctactttcgacatgacagcagggtagtagccgcctgactgaagcgctgccaggccaggtcgggggccagagcagcgtactgatccgccgcgatgccccgggcgggcaggccaagggcttgaaggatggcctcctgccaagcgtcgatgtcattcaccggcgcataacgcccggtttcagccaactgctcacgaaagacgggcaaatcgctggtcagcaccggtacaccggacatcaccgcttcctgcaggatcaggcccaggccctcgtccagcgacgggatggctacccagtcgaatgccttgtaaagcatcgccgcatgcttcagatgcccaggcagcgaaaccttgtcttgcaggcccagccggttgatgcgggcctcgagcgctgcgcgattcgaaccctcgccgataatcaccagacgcatctccggccggctcgccagggctttggcaaaggcctccagcaggcaagtaaaacccttatcgtccaccagacgcccgaccgcgccgaataccggagcatcgtccgcgggcaggccaagggttgcccgggcctcggcacgcggtagcagccttgcgttgaactcgtgcggattgaacgcgctgcgcaaggccgtcaccggcatctgcaaatcgtcttcgagggatgaagccagggtctgcgaaacagccgcgagagtcagctgcgaggccgggaactgccggaacagctgttgatcctcgcggtgcaagcgcgtggagccgtggatcaccaccaccgcacgcatgtgcggtaatgacttgaggaccggcaacaaggtacgcgccactcccaggccatcgagcaacagcacttgggcgtcgctctcctgcaacgccttgcgaaaactggcccgcaaccagggtttgagcaagcgccagaaatgcttgcccttcagccgcgccgacgacaggttccactcccggcactcccccacttcggcagcgcatccggtggacgagccttgcagcagccaggtcttgaccacagtacctggctcggcctgagagaggatctgctggtgaaccttgtggacggaggcaaacgcactgccgcctgcccacatgacgttgagaatgctcattgggcgcacagccctttcgcggtattcgggaaagtgaaaccggtagaactaatggataaaccagccaataccgactccaaccaacaggactaaaacaagcttgatttgctcgcgacgactgcgccgagccttacgctgccgctcggcggcagtctccacatgcagaccgaaacctgtatgcaacaccgcatcgccttccaggctgacagccgtcaggttcagctcagcatagcgcttggacagcgctttctcgccgccgtgcccggcgaaaggcgcgcacagccgatattgcgccatccggcgcaggcccgggttcagggaaaagctctgccactcgggtttgtcggagatcagcggataacagggcacaccgccgatcacctcgcgagcccccaagtggatgtaagggctatggactcgcaggtcgtgggcataactgcgcaaccagacctgcagaatgtcctggcgttgctcgagaatcgctttcgaatcctcgacgaaacccgggcggtagaactcccagtcgtcttcgcaatggaagatatagggggtcttgacctgctcgtaggccaggtcgatcgacgccaactgcccgagcttcggccggttgacgaagaaggtacagtgatctttccagtgggcgggcacagccgtgcgcacccgctcgtcgcccgcatcttcggtgatgaagacttcgcggatcggcgcactgttgaagcgatcgaaactctccagcgtgagcttgagcaggtccaggcgaccgcaactggtgaccaccaacgtgatgtcactctcttgactaaactgcacttgattctcacctacgacaaagtgcgatcactattaagggctcggtgaccgctgtcaaacacccagcttcgagcgtacgcgctcgataaagctcaagggtgcacgaggccgcaatgcgggctggagttcctcgacaatacgctgcccgatacgggcgaagctgaaccgagagaccgccagatcgcggccgtttcgcgcgatgctctgcgccagggccggatcggcgcgcaacatggcgagcttttcctgcaattgcgggatgctctgataaaagaccacgttgtgcaggtcctgcaaacccagcgcgcggttttccgcctcaccctggtcgaatgccagcaacacacagccacaggccatggcctcgaaattcttgatcatgtattcgcccatgccgacgtcggcactgacaaaaaagcggatgcggttgagcgtgtcgcaatactcttcgcccgacttggtccgcgtcaccaccaagggctcgacctggccgagctcgtcgagcagcgccttgcgtccgctgtaggccacgctgttggtgctgccgacgaatgccagttcgatatcccgctcgcggccctgatcctgcagcagggtctggtcgtagcccttgggcacgaataccgcgtcgaaaccttcctcgcgcaagcgctcgctgaccatgaaccccgaactgatcacccgtgcccacggcaggcggcggtagtgcgcgctgaacttgccggtgtacttgcaggggatgtagttctggtaggcgtcgtgctcgaggatcaccaggttgggaatgctgcggatgaagctcgcctggcggatttcctgcttgaaacgcaggaagaacacgatgcggtcgtagcgcgatacatccacctcacggcggaaatagccacgcaggttgcgctgctcgtcgctgctcaaccaccgcaggtcgcattcgcaatgagcggcaacgccttcgtacaggcggtccagaatggcccgctgttctttctgcaccagaaatagaaccttcatcatcttccttgcagccgtgagcaaccggacaaaagagcgaaactaccctggccgacaggcaaaagggtgtcatgcaatatcaatttacaaacgccagaacagctcatgccggcgtaccgccttgcggaaaaactcgttctcgccataaagcgaaccggcgcgaccggccaatacacgctgcaaggcccgacgcagacgacgcttgaacggcgctcgcggctgcaggtcgtgcatcatgcccagggccatcgccttgtcccgttgctgctcgatcgatagctgcaagcagcagggcctgagcacctgggccgggtcgaacaccggcggcagggcaatgcccgcccctgaatcgcccatcggccagcggtcgttgtcatgcaaatggttggcataaccgaacaaggtagtcggctgccactccagcccctgcaacgcttccagtaccgcctgctgggcgcagatgtggtccggatgcggatcgagggtcggatgcggcagcacgatcacctcgggacgcgccttgagcagcagcgcccgcaggtcggccaggagattgttccaggtcggcgcgccatcggcatccgccggcagcgggaacgggttgaactggcggaacaggcggatatccgacagttcggcctcgcgggacgccacaggccggttcggcgccgcctgcatggccggcagctgcaggcagaaataccccagctgcacacaacgttcctcggcgaccccggcccaacgcggcaccgcaatactgtcccaggcccgcagccggcccttgatccgcgccgcatccgcagcgttcatgcccatccgccggtaatgctcggcctcgatctcgcccgcggtcaacgtgacgatccaggtttcgtcagcctggctgtacaggccgaaggcagccagttcggcatcgtcggcgtggggggcgatgaccatcacccgctggtggcgatagtccggctcacggaacaccgacaacagcggttcgccatgcacccgacagaaacgtccgcgcaattgcagctcgccgctggccagaggtcgtgccagcccactgagattgagataacgcaggccgttcacgccacgctcgaacgtctgccgatcctgccccgccaaggagacggaggggtcgaaaaagcgccccagccagctgctgctgacctttaccgcgaggatcagggtttcgtcccccgccaggtcgatcgcctggtccagcaccaagcgctgcttgtccaggtggaccttgggctgctcggtgccgaacggaaagctgtactgataatcgtcccggggcgaataaaacaggtggtcggcgaaccaggcctcatgggccacccaggccagcaccgcgagcagcagcggcagccaccaggccaccagcacaccgatagccagcagtaccagcaggccgatcagcaggcccaggcgcttctgccggcgatggcgtttgagcaactgttgcttgcgactcggcggctgattcataccgtgaacaccggaaccggattgcaccaacgatccttgtattcgcgatcggcgcgaccgaaggagaaacgcagcggcttgtcgatggcccgcgcctgctcccaggcgctttgcgtattgaggaaactcaacacgctgccggggctgaactcgcgggtttcaggatcgacgccaccgttgatgtattcgacgctgatccactccggcgcttcgacccggtacaccagctgaatggcgatcggcgcatcgttgaggaaaatcaccgaaccgatcagtaactcgcgcagcaactcgatgacgtcggccatgcgctcggcaccggtggccgggaacccccagcgccgctggaacagatcgcagtagatggccgccagctcctggctggagaactcgctgaccgggcgcaccacgccgcccgcctcttccagcaggcgcagttcgcggcgctggttgtagcggaacttcttcgacagctcttcaggcgtgcgagccatggccaattgctcggcctggggcttgagggtgctgaaccggccctggttcaaggccgacagataacgaccgcgatgacgcagcggggcctgggtctcaggcgccgccggcaggatcagctcggcgttgcccaggtcgaacaggcctttcttgccacggcgcttgagcacatccttggacagagccaggtcgcgcccccaggtcgggatcgccgcccgcagttcgccggcgtgttcccaggccaggtagcggaccgggatgcccgccaggttcgccaggcgctccaccaccagcggatgggtggcgacgctgccgccaaaacgctgccaggcggcggcataagtcgaggcgtcgacgaccgaccagccacgctcgcgccagccttggaatcgattgagcatcagggcctcgcggtcagatcggtaacttgcggcagacgccagaaggcgtcgcgtacagcacggtcggagaagcgctcgcgcaggcgctcgaacatcagctcggcgcacagcaagcgctggttctcatccatcccggccaggtgttgcaggccctgggccatatgctcggcatcgcccagcgggaacaggatgccgacgccttcgaccacttccttggcaccgccacaggctgtcgccagcaaaggcacgccagcggccatggcctccagcagcaccatgccgaatggctcgtggtcggaactcagggcaaaggcatcgaaagcacggaaataacgccgggcttctgtgacctggccgaggaacagcacgcggtcggcaatgcccagctcgcgggaaaggtccttgaggttctgctccaggcgcccgctgccgagaatcgccagctggctttcccgaggcagccccggcaatgccgtggcaaacccgcgcagcagggtggcctggtccttgtccgggtgcagacgcccgacattgccgacgatccaggccgaagacgacagccccagctcctggcgcgcttcggccttgggcagttgggtcgcctgcaaggcttcgacgtcgatccggttgtacagcgtctggatccgcgccgccggccattgtggcaggcaactgcgcatgtcatcgcgcaccgcgtcggacacgccgagcaggctcaggcgcttgcggaacaggttggcgaacaggcggcgactgccgcgctggtaatcgccaaacgcgtgatgcacaccgatcaccggcaacgcggtgcccagcaatgcgatgtagatcggcttgaaacggtgggcgatgcagaagctgaagttgcgcgacgcggcgatcttgcgcaggtcgcgtatcgcccccagcttcaggccacgaatggccctggagctgtattccatgaacagcacttcatcgctggcacaggcatcggccacctcggcgtcggcgaccccggtgaggaacaccgtggtcacgcgatagccgctgcccgcgaacaggctggcgtattgccgggcacagtcgaggaacggcccgtcatagccgtggcagaactgcaggacgtggcgctcagccgagcgtgtcataaggatccacgccgtctttgactaccaggatgtcttccatgatcaggtactgcaggtcggagccgaagaacatgttcagggcgtcggtcggcgagcagatcatcggctcgccgcggcggttgagcgaggtgttcagcgacacgccgttgccggtcaggacttccagggccttcatcatgtcatagtagcgcgggttgtattcgcgcttgagcacctgggcccgggaagtgccgtcttcgtggaccacttccggcacgcgggtcttccactcctccgccacttcgaaggtgaaggtcatgaatggcgccgggtgatcgaccttgatcatctgcggaccgacggtgtcgagcatcgacgggcagaaaggcctccagcgctcgcggaacttgatctgctcgttgatacggtcggccacgccggtagcgctcgggcaaccgatgatcgaacgaccgcccagggcgcgcggaccgaactccatgcggccctggaaccaggccaccgggttgccgtcgaccatgatcttggcgatacgctcgggggtgttgtcgatctggcgccaggccggcttgttcgggtggcgggcacaggcggcgatcacgtcttcgttgctgtaggacgggccgagatagacgtgttccatcttctccaccggcacgccgcgagcgtgggaaacataggccgcggcaccgaccgcggtaccggcatcgccggacgccggctgcacgaacaactctttgacttccggacgggcgatgatcttctggttcagcttgacgttcagcgcacagccgccggcaaaggccagcttgccggtttccttgaggatgtcgcccaggtaatggtcgatcatctgcagcgccagcttctcgaacagcgcctgcatgctggccgcgtagtggatgtacggctcgtcggcgatgtcgccttcgcgcttcggacccagccactcgatcagtttcggcgagaagtagaaacccttgcccttctctttataacggcgcagaccgatgacattggcgtaatcggtgttgatcaccagttcgccgttttcaaagctggccaggcgggagaagtcgtacttgctggcatcgccgtacggtgccatgcccatgaccttgaactcgccgtcgagcatttcgaagccgaggaactcggtgatcgcgccgtacaggccgccgagggagtccgggtcgtagaattccttgatcttgtggatcttgccgttttcgccgtagccgaagaaggtggtggcgtactcgcccttgccgtcgatcccgaggatcgcggttttctccttgaagccggagcagtggtaggcgctggaagcgtgggccaggtggtgctcgaccggctcgatcttgatcttcttcggatcgaagcccagttgctcgaggcaccagacgatcttgttgcgataacgcttgtagcggcggttacccatcaggatcgcgtcgagggcgcggtccggggcgtaccagtaacgcttggcgtagtgccagcgggccttgccgaacaggctgatcggggcgaacggaatcgccaccacgtcaacgtcggaaggtttgatgccggcctgttccagacagaacttcgccgattcgtagggcatgcggttctttgcatgtttatcgcgtacgaagcgctcttcttcagcagccgccaccagcttgccgtcgatgtacagcgctgcggaaggatcatggctaagggcgccggacaggccaagaatcgtcaatgccacaggggtctagcctcgtttagtctgcatgcgggcgcgatgcgccttgaaaatgatgtgtgctcgcaaggggcgagaaacaacgaaagggcgggattataacgtaaaagaaggggcaagcctctagcgacaagcgccaaggctgaagcgcctcactccctgtagccactgccgcaggctgcgataaggcccgcagggccttccgaggacctcaaaagcagcgcctcctgcggagtcgatcgcagcctgtggcagtggctacaagtcgcaggtcagcccatggacgattcgacggttttaggcagacgctggtcgatgacctgatacagcacgctgctttctggccagttacgcatgaagcgcgcacggtcgcgggcgtaggccggggcgaagctgccgaggctgtggtgttggcacatcgagtccaggtcgatcagcgcccagcggtcctcttgccagaacaggttgtgccccttgaagtcgccatggctgatgcgttcgcggatcaactcggcaaacagccggtccagcgcctgcaactccgcttccggagccgcgccgctgtcgatatagggcgcgaagcgttcgatgatgtccggccccgccaggtattcggtcaccagataggctcggctgcgcagccagagaaaacgcttctccagcaaagccagcggcttgggcgtggcaatgccgaggaacgccaggcgattgccctcctgccatgaatgccaagcccggctgggacgccagaagcgcttgagccaatgggcaaaacccttgatgttgtagcgcttgaccaccagggtgcggcccgccacttcgacccggccgacgctggcggcgccaccggtcttgtacaggtacccccggtccagcagcgcgtcggcctgtttcagcaccggcagcatcgccgcttcttcctcgcgccgaattgcccgcaaggcgaagggcccgcgcagcacgctgaacagggtgcactcgcgaccgaccttgttgaggaaatccttcaagcgccagctgcgcaccttgtccacctgcttctgcaaggcctctagcggcaaggcatgctcggcattattcagcaggtaatgcaccagcagctcttcggtgaagggctccaggctcttgggcaactgggcgaaaaacaccccgaggttttccaggactttctgccgggacagcggcttgcccgcctgttccacgcagatcccggcaccgtcgatcagatacagcttgccctgatgacgcagcaggttgtccagatgcaggtcttcctgccacaggcccttgccatgcagttcggcaatggcggccagggcctcggcgagtactgcctgctgctcatcggccagcgccggcaacgactccacctgtttccaggcatcgcccaggctctcggagccttccaggaactcgaacagcagccagccgccctcgccttccttcaggccgtcggccagcaacagcggcgtggtcatgccctgctcttcaagcaggcgcacaccctgcagctcacgctggaaatgccgcgccgccttgcgccccaccagtaacttggccagcaccggacgcccgcgccatacaccggcgccgacgtagcgctgccccggtagcacccgcagcaggctgagcaactgcagcgtggccggcccggcagcgtcggccagctccagactcaacggcaggcttggcgcgcggccggcccgttcaagttcggacagacgcatcaacgagtctccttgtggctgcggcgcgcactcaggcggttcagccaggcatcgaccagcgagctgtcccgcggctgatccagataggtcgcaagcaaggcgcgcacatcgccctcactccagaccggggcgcgacgcaacagcggctccaggtccttgacccggtcacgctggccgaacaacagcggacgggtcttttccaggtcgatcaattgcgcctggtaaccgtcgccggtggcccgcaggaaaatatgcttgggataaaagcagccgtgcacctggcgcagcgcgtgcaactggcgcgccagcaggccgcaggcccgcaggatcgctgcgtgctggtccgggctgagctgcgcccattgttgcagcagcgaatccaggtcgttccagccatccagcgcccgggtcagcaggatcgccctggtttcgccagccaccttgcgctcgccaaagaaggccgcctgcagcgctggaatgcccaactgctggtagcggctgatattgcgaaactcgcgggcgaaactcggctcgccgaacggccggtgcagggtccgcgtcaggtagttgctctggcgcttgaggtagtagccgtggccttccaggtcgaggcgatacacgctgctccagcccccgccatcggtgttgggctcgtccaccgcttcaagttgcttggcccacaacgcgtcgaagctgtcgaggccgtggcgctccagcaacgcacggtcctgagccgccaggaaatcggtcattcgcgtccctcgaaaaatctcagcacgtgccggatacggcacttgtccgcggcattcagccgggtgcgctggcggtactgcaaatagaagcgcaggcgctgggtggcggataaatgatacttggccaccttgtccaggcacgccaggtccttggtgatccggtacttgagccagaaaccgcgccagaaatcgccattgggacaatcgatcagatacagccggacctcatcgtcgatcagcaggttgcgccacttcaagtcgttatgggtaaagcgatgctcatgcatgatccgcgtgtagcgcgccagctgctggctgacccggtccacccaggcccgatcggccagcagcgggtcgttgcgctcggccaggaccgacaggtcttcggtgcgtggcagctcgcgggtgatcatcgccccacggtcgtacgccaggccacggcgctccaggccccaggccaccacctcggcagtgggaatgccccacttggcgaaacgcttgaggttctgccactcggacttgacccgtggcttgcccagatagcgccgcaggttcttgccggcgccggtgtagcgcttgacgtaatagttgatgccgttgcgttcgacccggatgacctccgacaacgggtcgcgggtcaggtgttcgccctcgagggcaaataccgcatccagactgccgaagtcctgcgccagctcctgatatccaggttcaaggttccaacccgccatcagagcgcatctccgtatcgctgcttgcgtgcgtacagcttgttggccttgccctccagccaggccagcagaggcgcttcgtcgctcaggatctggcgcaacggctgctggaaataacccttgaggaagcgcagcttgtcgcgccgggtcaggccgatatccagtgccgagaaatacagcgccgccaggtccttgtcgcgccagcgccgggtgatggccggacgagtctgggcgcggtgcaggtcgatcaccgagagcttgaaatcatcgggtgtcaccggcttgtcggtgtgcagcaggaagtggcagatgtagcagtcgcgatggttgaccccggcgcggtgcatcatgccggtcatgcgcgccacttcggcgatcagcgcacgcttgagcctgggctgcggcggctgcttgacccagtcgatgctgaagtcttcgaggctgatggtcggcgccagctcctcggtgacgatgaacgaatgctggttggccgggttgctgccgcgctcgccataggcgacggcggtcatggtcggcacgccggcttcctgcaggcgctggatggcctgccattcctggcccgcgccgagcaccggcagcttggcggtgagcaggttcttgaagatctcgccccaaccgataccgcggtgaatctttacgaagaacccttcgccggccacctcggtacgcaaggtacggcgggcttccagttcacgatagacctggccgtccagacgctcgacttcggcgaacgcatcgcgtccggcccaaagggtcttgaacggttcggcaagaatcaacttcatcagtgttgctccgccagaatcacatccgcagcgtgctgcggcatgctatagaggtcggccgtctcggcgaacgccaggccgttacggctccaggtcgcgcgtgcagcgtcgtcggtcaacatggtgttcaggtattgattgagctgtccctgctccaatggctcgtccagtaccaggccgctgtcggcctcggcgatgtaatgggcataaccgcagaccgcgctgaccagcaccggcaagccggccaccagcgcttccagcagcacggtgccggtgttttcgttgtacgccgggtggatcaacaggtcggcgcccaacaggaaacgcgggatatcgctgcgccccttgaggaactgcacatgctcgcccaggcccaatgccgcgctctgcaattggaatactttggggtcgtcctggccaattacaaatagccgggtgcgtttcttcagctccggcggcaaggcggccacggccttgagactgcgatccacgcccttggtcttgaacccggagccgatctgcaccagcagcaaatcatcgtctttcagggcgaactcgcgacggaattcggcgcggatccccgccgcattggccggtgcgcgacggtcctgggcgatgcctggcggcagcaggtggaaacgctccaccggggtgtcgtaatgcttgatgaacagcggctgctggacctcggaaatcatcagcacttcggtcttggcgtcccgggcgaacaccgcgcgctcgtattcggcgaagtgccggtagcggccccagcggcggtacagcgaatggcgcaggttctgcgccttgtcttcgaagcagccgtcggcggcgtagtacacgtccaggccgggcatcttgttgaagccgatcaggcggtccaccggacgcttggccaggtcggcctccatccaggcgctgagcttctcgttacgacgatggttgaagaacgccttgaccggcgccaccagcacctcgaaacccggcggcacatcgccttcccagatcagcgtgtagacgcgaatctggtgcccgcgtttctggcactccagggcgatgcgcatgaagtcccgttgcaggccgccgaacgggaagtatttataaaggacaaaagccaattgcatcagcgcagctcctcagccagtaacaacctgctcagccggctggcgacacgctcaggattcagacgcgtgaagcacagcggccactcgcgtttcaggtcgaaccgccgctgatcttcagccgtcggttgataggtgcattttttctgcaggcacggcgcgcaggggaagtcgctggccatgtggatctgcgccttgccataggcaccggtcaggcccgggttggtcggaccgaacagggaaatggtcggcacatccagcgccgccgcgagatggccaagcccggtatccaccgcgacacaggcccgggcttgcgccagcaccttggcgacgcccgccaagttcagcttcggcagcaccgtggcgttgctcaggcccttggcaatacgctcggcccgggccttctccgccgggttgccccacggcagcctgacctcgacgcccaactggcccatgcgttcggccagctcgcgccaataggcttccggccagtgtttggtgtcccaggtggtgccgtgcaggaacaccacgaacggcttgggccgcggcaactccaccagtttctcgacgttcaggccgtaatcgcccaggccttggggcaagtcataccccagggccacggcgaacagctggcgcacacgctccacggcatgctggccgcgggcgacggccaggcgccgcgaatagaaacgcgccgccaggggctcgcgtgccgactgcttgtccaggccggccaccggcgccttgacgtagcgcgtcagccaggcgcttttcagcaagccctgggcgtcgatcaccaagtcgtatttagtcgcacgcacgctctgcttgaagcgccgccactcgccactcttgatggtctgccagatgttcttgcgccagcggcgaatcgccaccgggatcactttatccacagccgggtgccaggtcgggatttccgcgaacccctcttccaccacccagtcgaacttgatccccgggatcgcccgcgccgcatcggtcagcgccggcagcgcatgaatcacgtcgcccagggaagaggtcttgatcaacagtacccgcacttaccgaacctcgaccgcagtgccttgcaaccgctgcaaggcctggtccaccgagtcgggcaacagctggcgcaggcagttgtaatggccaaagcgacaggtgcgatcgaagcacgggctgcactcgatgcccaggcgcacgacttcgacctggtcggccaagggcggggtgaaacccggagacgtcgagccgtacaccgccaccagcgggcgattcagcgccgccgccacgtgcatcaacccggagtcgttggacaccacggaatcggcgcaggacagcaggtcgatggcctcggccagggaggtgccgccgcagaggttgaccgactcttcgcgcagcccaggaatcaatcgggcgcgaatgtcttcgccgaccacgtgatcgttcttcgaaccgaacagccagacctgccagccctcgcggatcttcagctcggcaaccttggcgtaatgctcggacggccagcgcttggcttcgccgaattcggctcccggacacagcgccagcaccgggcgatccagggtcaggccgaacttggccagcgccgcttcgcggctggccggatcgatctgcaggtcgggacgcggatacggcttgggcagctcggcgcccggctcgtaagccagggccatgaagcgctcgatcatcagcggataacgttctttgtccagcgtgcgcacgtcgttgagcaggccgtagcggaactcgccacgccagccggtgcgttgcgcgatgccggcaaaaaacggcaccagcgccgacttcaacgagttgggcagcaggatggcctggtcgtactggccgaccagggatttgccgatgcgccggcgagtcgccagttccagcacgccgtggccgagcgggaagctcaaggctcgccgcacttgcggcatgcgctccaggatcggccggctccactcgggggccagcacgtcgatctcgcattgaggatggcgctgtttcaggcactggaagagtgtctgcgccatcaccatgtcaccgacccaactgggcccaacgatcagaatattcatgtggtttccaaaaacgaaccggggaggcttacgcctccccgcctcgagaatccagccctgcggcattcaccgccggctcattgtggacgagccgcaacctggctcgccggatacatttgtggcaacgcagcgcacgctgcctagcttagccccagctcgcgccaaatccgcaatacctcccgtcgctcgctggcgaactggtcgccggcgatgaccccggcctcgttctgcaaggcctggcggtgagccgcggagcggtaggccttatagacctcgcgcaacagactggcgtcggtcgcgggcatcagcccgacttcctccagaccttccagaatgcggatattgtcggtgtagcgcagcaatgacgggtgctcttgcgaccacgccagggccgcgtattgcaccataaattcgatgtcgacgatacctccggcgtcctgcttgaggtcgaacggcgccgtggcctcgaaggcatttgccgcggttccggcagccgtcgccctggtccccaggttgtcgcgcatcttggcccgcatctcgctgacctcctgctgcaacttgggcagatcacgggcacgacccagcaccgccgcccgcactttctcgaaggcctggccgacatcctggctacccaccagcacccgggcacgcaccagcgcctggtgctcccaggtccaggcttcgttctcctggtaacgagcgaaagcccccagcgaactcaccagcaagcccgacgccccggacggccgcagacgcatgtccacttcgtacagctggccggagttggtctgggtggtcagcaggtgaatgatccgctggcccaggcgggtgaagaactgcgcgccgtcgatcggtttcgggccatcggtttccgcctgcggatcgccgtcatggatgaacaccaggtccaggtcggaaccatgcccgagttccaggccgccgactttcccataaccgacaataatgaagccgggatcgcacaaggtgccatcggtgcgctgcggagcgccgtatttggccaccgtctggcgccaggccagggccagcacctgttctaggatcgcctcggccagccaggtcaggtaatcgctgaccttcatcaacggcaggctgccggcgatttccgaggctgccacccgcaggcggtgggccagcttgaagtgacgcagcgcctccatctgctgttccagatcgtcctcggggatgcgcgtcaggcgctcgcgcaactcggcggccagttccggcgccaatggcggcttgaacagccggccttcgttgagcaactcatcgagcagcagcgggaagcgggtgatctgttcggcgatccacgggctggcggcacacagggtcagcaggcggcgcaaggccccgggattctcggtgagcagcaccaggtaggccgaacgccgcgccaccgcctcgaccagcggcaatacccgctccagcaccaggtccggatcggcatgctccaccgcctgggccagcaggcgcggaataaaggcgtcgagacgctcgcgccccaaacgctgcatggctcgcaattgcgggctgccacgcaggccggccagcgccctgagcgccttgggcgcgtcattgaaaccgccttcctgcaactgccggcaggcagcttcctcgtcctgggcttcttcccacagcggcagccattcaccgccgaccaccacttcgcattcgctgccttcgtcttcatccgggtcggcgatcacctgacggaagtgccattccacccgaccgcgccagtacatcagccgctcatggaacgctgcccagtcggcaaaacccagcatgaaggcaatacgcgcctgatcctgtggattgtccggcaacatctgcgtctgccggtcggcgatcgcctggatcgcgtgctcggtgtaacgcaggaattcgtaaccttcacgcagctcggcgatcaccgcgggcggcaggtaaccctgcccctccagggtggtcagcacctttaatagaggacgctgctgcaggctcaggtcgcgcccgccgtggatcagctggaaagcctgggcgatgaactcgacttcacgaatcccgccggagcccagcttgatattgtcggccatgcccttgcgccgcacttcctgctggatcagctgcttcatggtgcgcagcgcttcgatcgccgagaagtccaggtaacgccgatagacaaaaggccgcagcatgtcgagcaactgcgcgccggcgatctggtcacccgccaccacccgcgccttgatcatcgcgtagcgctcccagtcgcggccctgatcctggtagtactgctccagcgcattgaagctcagcaccagggcgcccgccgaaccgtagggccgcaggcgcatgtcgacgcgaaacacgaaaccgtcgacggtcatcgggtccagcgccttgatcaggcgctgccccaggcggatgaaaaactcctggttatccagcgcacgcttcacgcccacggtctccccgccttcggggtaggcgaagatcaggtcgatgtcggacgacaggttcagttcgacggcgcccagcttgcccatgccgaggatgaccatctgctgcggctcgccgctgcgccggccggtaggaataccgaactgctcgcagtggcgctggtacaaccattgataggcctggtcgatgcaggcgtcggccatgtccgacaggtcgcgacaggtctgcaccagatccgcctggcgtgtcaggtcgcgccagatgatccgcacctgatgacgattgcgttgacgccgcagtacccgccccaactcgtcttcgctggtggcctgctgcaccgccgcggcgatctgcgcgcatagctcgcccgggccgaagccgcggtcgagctcaccgccgcgcaccagctccagcaacatcaaagggtcacgaaggctctgttcaatgaaaaagtcgctggcggcgctcacccgggcgaactcggcccagcgctcgggggtccaggcggcgagcccgtgatcgtcgtccagggtcgccacggcactacggaacgactgctccgcacggctgacaaaaggcaggagagtcgctgggagttcggcaagcgcgggcaggctcatgggctatccttgatcggcgtagaaaggggcggtcggggcaaattctgcgggcgcggcccttgaaggactgtcgaacaaaagttagaaatagctgaattttttattattttggcagccagcatcaaattcttacccattggtgttggaaatcgaccaacagtaacgattattctcacaacgcagcaggaggccacaagccaatcttctgtagttttactactcgtctatacattcgaaaggctgaaatggccgacgatttgtagtaaaactacacgccgccgtatcaacctccggcaatccaagaattttatcgtctgcccacaaggccagtcgcaaactcaggcaaccgattctggaagcctttccgccctggagcaagccatgcaagacctcgatcccgtcgaaacccaggaatggctggacgccctggaatcggttctcgacaaagaaggcgaagaccgtgctcactacctgatgacccgtatgggcgaactcgcgacccgcagcggctcgcaactgccctacgccatcaccacgccgtaccgcaacacgattcccgtcacccacgaagcacgcatgcctggcgacctgttcatggaacgccgcattcgctcgctggtacgttggaacgcgttggccatggtcatgcgtacgaacctgaaagattctgacctgggcggtcacatctccagcttcgcttccagtgcgacgctgtatgacatcggcttcaactacttcttccaggcgccaaccgaagaacatggcggcgacctgatctacttccagggccacgcctcccctggcgtctacgctcgcgctttcatggaaggccgcatcagcgaagaccagatgaacaacttccgccaggaagtggacggcaacggcctgtcctcctacccgcacccatggctgatgcctgacttctggcagttcccgaccgtctccatgggtctgggtccgatccaggcgatctaccaggcgcgcttcatgaagtacctggaagcccgcggcttcatccagccaggcaagcagaaagtctggtgcttcatgggcgacggcgagtgcgacgagccggaatccctgggcgcaatctctttggctggccgcgagaagctggacaacctgatcttcgtcatcaactgcaacctgcagcgcctcgacggcccggttcgcggcaacggcaagatcatccaggaactcgaaggcgtgttccgtggcgcccagtggaatgtgaacaaggtcatctggggccgcttctgggacccactgctggccaaggacaccgacggcatcctgcaacgccgcatggacgaagtcatcgacggcgagtaccagaactacaaggccaaagacggcgccttcgtgcgtgagcacttcttcaacacgccagaactcaaggcgatggtcgaagacctgtccgacgacgaaatctggaaactcaaccgtggcggccacgacccgtacaaggtctatgcggcctaccacgaggcggtcaaccacaaagagcaaccgaccgtcatcctggccaagaccatcaagggttatggcaccggcgccggcgaagcgaagaacaccgcgcacaacaccaagaaagtcgatgtcgacagcctgaagttgttccgcgaccgcttcgacattccggtcaaggacgaagagatcgaaaacctgccgttcttcaagccggaagaaggcagtgccgaagcccgctacctgagcgagcgtcgtgccgcgctgggcggtttcgtgcctcagcgtcgcgccaagagcttcaacatcccgaccccgccactggataccctcaaggccatcctcgacggttcgggcgaccgcgaaatctccaccaccatggccttcgtgcggatcctcgcgcagctggtcaaggacaaggaaatcggccagcgcatcgtgccgatcattcccgacgaagcccgtaccttcggtatggaaggcatgttccgtcagctgggcatctactcgtccgtcggccagctctacgagccagtcgataaagaccaggtgatgttctaccgcgaagacaagaagggccagatcctcgaggaaggcatcaacgaagcgggcgccatgagctccttcattgcagccggtacctcgtactccagccacaaccagccgatgctgccgttctacatcttctattcgatgttcggcttccagcgtatcggcgacctggcctgggccgctggcgacagccgtacccgtggcttcctgatcggcggtaccgccggccgtaccaccctcaacggtgaaggcctgcagcacgaagacggtcacagccacatgctggcgggcaccatcccgaactgccgcaccttcgatccgacctatggctacgagctggcggtgatcatccaggacggcatgaagaagatgaccgaagagcaacaggacgtcttctactacatcaccgtgatgaacgagtcctaccagcagcccgccatgccggccggtgtagaggaaggcatcatcaagggcatgtacctgctcgaggaagacgcccgcgaagcggcgcaccacgtacagctgatgggctccggtaccatcctgcgcgaagtccgtgaagcggcgaagatcctgcgtgaagaattcaacgtgggcgcggacgtctggagcgttaccagcttcaacgaactgcgtcgcgatggcctggcagtcgagcgcagcaaccgtctgcacccgggccagaagcctaagctgagctatgtcgaagagtgcctgagcggccgtaaaggtccggtcatcgcctctaccgactacatgaagctgttcgccgaacagattcgtcagtgggtcccatccaaggagttcaaagtcctgggcaccgacggtttcggccgcagtgacagccgcaagaagctgcgtcacttcttcgaagtcgaccgtcatttcgtggtgttggcagccctggaagccttggctgaccgtggtgacatcgaacctaaggtcgtggccgaggccatcaccaagttcggcatcaacccggaaaaacgcaacccactggactgctgaggagattttttgtgagcgaactcattcgcgtacctgacatcggcagcggtgaaggtgaagtaatcgaactgtttgtgaaggtcggcgaccgtatcgaagccgaccagagcatcctgacgctggaatcggacaaggcgagcatggaagtgccggcacccaaagccggcgtcatcaagagcctgaaagtgaagctgggcgatcgcctgaaagaaggcgacgagctgctggaactggaagtcgagggtgccgcgcaagcggctcctgcgcctgccgctgcaccggctgccaaagccgaggccaaaccggctgccgctcctgctgccgctcctgctgccgcgccagctgctcctgctgccgcttcggttcagcaagtgcacgtgccggacatcggttcgtcgggcaaggcccagatcatcgagatccaggtcaagatcggcgacaaggtcgaggctgatcaatcgttgatcaccctggaatccgacaaggccagcatggaaatcccttcgcctgccgctggcgtggtcaaggccatcagcgtcaagctcaacgacgaagtcggcaccggcgacctgatcctggatctggaagtggcaggtgctgcggcccctgctacggctgctccggcccaggcggctgctccggcacctgccgctgcgcctgctcctgcggcagctccggctgctccagtggccgacagcgtccaggacatccacgtcccggacatcggttcggccggcaaggccaagatcatcgaagtgctggtcaaggctggcgacagcgttgaagccgaccagtcgctgatcaccctggaatccgacaaggccagcatggaaatcccatcgccagccgccggcatcgtggaaagcgttgcgatcaagctggacgacgaagtcggtaccggcgacctgatcctcaagctgaaagtcaaaggcgcggcacctgctgctgccccggccccagctgccgcggctgcgccaagcgctccggcacctgccgctgctgctccggctgccgctgcacctgctgccgcaccggccgctgcacctgccaagcctggcgccaaagttcacgcaggtcctgcggtgcgccaactggcccgtgagttcggcgtcgagctgagcgctgttggcgccagcggtccgcacggtcgcatcctcaaggaagacgtgcaggtttacgtcaaagcgatgatgcaaaaggccaaggaagcgccggctgctggcggcgcaaccggtggcgcgggcatcccgccgattccggtggtggacttcagccgcttcggcgagatcgaagaagtgccgatgacccgcctgatgcaggctggcgcatcgaacctgcatcgcagctggctgaacgtgcctcacgtcacccagttcgactcggccgacatcaccgagctggaagccttccggatcgcccagaaagccgttgcagagaaggccggcgtcaagctgaccatcctgccgctgctgctgaaatcctgcgcgcacctgctcaaggaactgccggacttcaacagttcgctggcgcctagcggcaaagcgatcatccgcaagaagtacgtgaacatcggcttcgcggtcgacaccccggatggcctgctggtaccggtgatcaagaacgtcgatcagaaaagcctgctgcaactggctgccgaagccgcttccctggctgagaaggcccggaccaagaagctctcggcggacgacatgcagggcgcctgcttcaccatctccagcctcggtcacattggcggcaccggcttcacgccgatcgtcaacgcaccggaagtggcgatcctcggcgtttccaaggccaccatccagccagtctgggacggtaaagccttccagccgaagctgatgctgccgctgtcgctgtcctacgatcaccgcgtgatcaacggcgccgctgctgcacgcttcaccaagcgtctgagcgatctgctggcggatatccgcaccatcctgctgtaagactcggccggcttccctgtcatggggaagccggccgttgcacccttttcgagcgccatgctcgtacctcaaccccgtcgatttggcggggcttttttttgccgaaaaatcgccgtaaccagccgccaaagcccgctaaaacaccaggaaagattagcgttcagaaatcttccgttctgccgatagattcttatagcacttagccttcatctcacttgtcagtcagtgccgcatgatgcaaccttgccgcaggcaacagtaaagagggcgtgagcccggcgcgatcagcatttaccaagcgagtttccccatgaaaagccaacccgatgccgccagccgtatggtggccgaggtagtgacgcagttgcccgtgccctcgcggctcggcatgctgcgtttcgaacggctgaatgaagcgagctgggccctgctgtttctcgatccaaactgtgaacgccaattcggcctgcccgccgtcgagctctgcgccctggtcggctcgccctatgccagcctgatggagccggaagcccgttatcagctgcacgatgcgatccagcagcaactgacccacagcccgcattacctgattcgctacaccctgcacaccgccaagggctcactcagcctgctggagctcggcgaagcctacaaacagcacaatcgacacctgctccgtggctatttcctggtggtcgacggcctgctcgacaacgatcagccgctctccgcgcctgacctggaaacccagaacagccgcctgcaaatcgccctggaactcaaccagcgggcccagctggaacaactccagcacctcgaacgggtgcgcgcccagcaagacctgatcctgctcctggcccgccagcgctacagcgccaacaactccctgctggaagccgccgagctgattacccgcagcgcctgcgacatctacgaaatcgactgtgccagcatctggaacctggaaggccagttgctggtgcccatctgcgcctatcaccgcgacctgcaggaatacatcctgccggaggcgatcgacgtcagcgacttccccgactacctcgaagccctgcacaccagccgggccatcgatgcgcacaatgccatgcgcgacccgcgcacccgggaaatggccgaaagcctgcgcccgcgcaatatcaatgccatgctcgacgccagcatccgcatcgacggccaggtggtcggcgtgctgtgcctggaacaagtgggcaacacccgcgcctggcaatccgatgaaatcgcctttgccggcgaactggccgaccagttcgcccaggtcatcaacaaccacaaccgccgtaccgccaccagcgccctgcacctgttccagcgcgcagtcgagcaaagcgccaatgcctttctgctggtcaactgcgacggcgtggtggagtacgtcaacccgagcttcaccgcgatcacccaatacagcaccgaggaagtccacggccatcggctggcggaactgccggcgctggagaacctcagcgaactgctgttcgacgcgccctccagcctggccaagagcaacagttggcagggcgagttcaagagccggcgcaagaacctggagccgtactggggccagttgtcgatctccaaggtctatggcgacaaccgcgaactgacccactatatcggcatctacgaagacatcacccagaccaagctcgcccagcaacgcatcgagcgcctggcctacaccgacaacctgaccaacctgggcaaccgccccgccttcatccgcaacctcgacgaacgcttcgcccgcgacagcgacagccccatcagcctgctgctggtggacatcgacaacttcaagcggatcaacgacagcctcggccaccagaccggcgacaagctgctgatcagcctggcccggcgcctgcgcaacagcctgagcccgagcggcagcctggcgcgtttcgccagtaacgagttcgccgtgctgctggacgacaccgacctggaggccggccaacagatcgccagccagttgctgatgaccctcgacaagccgatgtttgtcgacaaccaactcatcagcgtcaccggctccgtgggcctggcctgcgcaccgctgcacggccgcgatccgcagaccctgatgcgcaacgccggcctggcgctgcacaaggccaaggccaacggcaaacatcaggtgcaggtgtttaccgaggccctgaacgccgaagccagctacaagctgttcgtggaaaacaacctgcgccgcgccctgacccagaacgagctggacgtgttctaccagcccaagctgtgcctgcgcagcggacgcctgctgggcctggaggcgctgctgcgctggaaccatccggaaaagggcatgatccgcccggaccagttcatcagcgtcgccgaagagaccggcctgatcatcccgatcggcaaatggatcgcgcgccaggcctgtcgcatgagcaagcagctcaccgccgccggcctgggcaatctgcaggtggcgatcaacctgtcacccaagcagttttccgacccggacctggtggcctccatcgccagcatcctcaaggaagaacaactgcccgcctcgctgctggagcttgagctgacggagggcctgctgctggaagccaccgaagacacccaccagcaactcgaccagctgaaaaagctcggcctgaccctggccatggacgacttcggcaccggctattcgtcgctgagctacttgaagaaattcccgatcgacatcatcaagatcgatcgcagcttcatccacgaaatccccgccaaccaggacgacatggaaatcacctcggcggtgatcgccatggcccataacctgaaaatccaggtggtggccgagggcatcgaaaccgcggagcagctgtccttcctgcgtcgccaccgttgcgatgtcggccagggctacctgttcgaccggccgatccccggctcggaactgatcgacaagctcaaacgttatccgcgcggcccaatcgcctgacagcgctgtaacactcgggcaaactgcgtgtctggttaattactcaatcccaccctgactgagaggactgatcatggttctgcgctcggaaattctggtgaacaaaaacgtgctacctaccaaagaacaagccctgcctggccgcgaaaccccgatgaccgtgccagccgaacacttcgtcaacggtaacccgctgctgggcccgttcccgggcaacgtggaattcgccatcttcggcctgggttgcttctggggcgcggaacgcaagttctggcagcgcgagggcgtgttcagcacgtcggtgggctacgccggcggctttaccccgaacccgacctacgaagaagtctgctcgggcctgaccggccatagcgaagtggtgctggtggtctacgagccggagaaagtcagctatcaggaactgctggcgatgttctgggaactgcataacccgacccagggcatgcgccagggcaacgacatcggcacccagtaccgctcggtgatctatgccaccaatccgacccagctggagcaggccaaggccagcgaaaaagtgttccaggccgagctgaccaaggccgggctgggcgccatcaccacggaaatcgaagaagccccgaccttctactacgccgaggcctaccaccagcaatacctggcgaagaatccggaaggctactgcgggatcggcggcactggcgtgacctgcccgatctgaccggtagccgctgacgaggcacgaggctgcgatgcggtccgcaggagcgccctcgggggccgcttcgctgcccatcgcagcctcgtgcctcagcagcggctacacctcacattattcggcgatcagccaatccatctgccagccgccctgggtctggcccaatttctgcgccaaccacggcagcagttcgcgcagctcctcttccagcccccacggcgggttggcaatcgccaggcccgagccattcaggctgttgggcgtatccaggggatgcaccagcaattccacacgcagcagcttcggcgcgccggtaccggccaggtcctggtagaagcggcgcagcgcccgctgatccttgaccgggtaccagatggccgccacggtctggcgcatccggccgatggcttctttcagcgacgcggcgcaacgctgcatctcgtcgagctgctcgaacggcgggtcgatcagcattaccgcgcgcttctcggccaccggcagcagcgctcgcgccacatgccagccctcgcccaggtggaccgccacccggcgatcgcccttcatgttttccttgagcagcaacccgtcttccggatgcttctcgttgagcagcacccggtcctgggaacgggtcaggcgccgcgccagctcgggcgagcccgggtaataacgcagttcgccatcggggttcatcttgtgcagcaccgccatgtagtcggcggtcagcgctggcaggtcctgctcgccccacaggcgcgcgatgccttccaggtactcgccggtgcggttggcctgatcgccctggaggtcgtacaggccgatgccggcatgactgtcgaggtaggcgaacggctgctccttgcgcgacatcagggcgatgaggcgggtcagggtcaggtgtttgaagacgtcggcgtggttgccggcgtggaaggcgtgacgatagttcatggttgctcctgcgcagggggcgaagtttaccctgtgccacggccggcgtcaggtcgtgtcgggagcttccacggcgcagtcacgcccataaaaaagcccgcatcccagggaatgcgggcttttcgaatcactgctgggttagcgcctcaacggctcccgatcagtggttgagcttgtagtctttctcggccgcctcgaaacgctggaccatgccggcgctcggcgcgctcatcttgctcaccagcaggatggccaggctggcgaagatgaagccagggatgatttcgtacaggcccagcacattgaagtgcttccacaggatcacggtcacggcgccgacgatgatgccggccagcgcgccgtcgcgagtcatgcctttccacagtaccgagatcagcaccacaggaccgaaggccgcgccgaaaccggcccaggcgtagctgaccaggcccagtacgcggttttccgggttggcggccatggcgatggcgaccagggcaaccagcagcaccatggcgcgaccgacccacaccagctccagctgggaagcatgtttacgcaggaaggctttgtagaagtcttcggtcagggcactggagcacaccagcaactggcagctcagggtgctcatcaccgccgccaggatggccgacagcagcacaccggcgatccatgggttgaacagcagcttggccagttcgatgaacacacgctcgtggttctcggtcacgggaccggccacttccgggtgcgccgagaagtaggcgataccgaagaagcccacggccacggtgccgcccaggcacaggatcatccaggtcatggagatgcgacgggcgttggcgatcgacttgaccgaatccgcggccatgaagcgcgccaggatgtgcggctggccgaagtagcccaggccccagcccatcagcgagatgatgccgatgaaggtggtgtttttcagcatgtcgaagttgcttgggtcctgggcttcgatcgccaggaaggtggtgtcgacgccaccggtggccagcagcacgatgatcggcgtcagcagcagggcgaagatcatcagggtggcttgtacggtgtcggtccagctcactgccaggaaaccaccaacgaaggtgtaggcgatggtcgccgcggcaccggcccacagggcggtctcgtaaggcatgccgaaggtactttcgaacagacgggcaccggcgacgatgccggaagcgcagtaaatggtgaagaacaccaggatcacgatcgcggagatgatccgcagcagcccgctcttgtcctcgaagcggctggagaaatagtccggcagcgtcaatgcatcgccgttgtgttcggtttgtactcgcagacgaccggcgacgaacagccagttcaggtaggcaccgacgatcaggccgatggcgatccagctctcggacaggccggacatgtagatggcgcccggcaggcccatcagcaaccagccgctcatgtcggaagcaccggcggaaagcgcggtcaccacgctacccaggctgcggccaccgaggatgtagtcagaaaggttgttggtagagcgataggccatgaagccgatcagcaccatagctgcgatgtagatcacgaacgtgatcaaggttggattgcttgcactcattgagttacgccctggctttgtttttatgtagcggcggtcagcaccaccgctctcaaacgactacgtttgagagacgactgggtactccgcgcatttatgactgatgtttccccaggaaagccatcagccgatgaaccggtcgcgagggccggttgcaccttgggcgcgaatgctattcaacaactcaaagaaggtgcaacctgtttcgcgagaataagttgcacccaagcgatttttccggcgaacgccccgtttttgctcctttttggagcaaaaacccatcgcgacagaattaaaagcaccaagcagaagcgccgcccaaggaccggaaattaattcctgatgagctgccaattattccgataaaaaacaggttgcacccggttgcacctctctcagctcacggctaatcttgccgccagctgatgccacgcaaccgtggtaaacatgaggataaaaatatggctaccaccacccttggggtcaaactcgacgacccgacccgcgaacgcctgaaggctgccgcgacctcgatcgatcgcacgccgcactggctgatcaagcaggcaattttcaattacctggaaaaactcgagggtggtgcaaccctgaccgagctgagcggttcgacccgcaccgacggcgatgacgctggcgaagtgcagaccgaccacgcccaccagtgcttcctcgaattcgccgaaagcatcctgccgcaatcggtgctgcgcgcctcgatcaccgcggcttatcgccgtccggaaccggaagtggtgccgatgctgctggagcaggcgcgcctgccggccaccatggccgaagccaccaacaagctggccgcgaccatcgccgaaaaactgcgcaaccagaagagcgccggcggccgtgccgggatcgtccagggcctgctgcaggaattctccctgtcgtcccaggaaggcgtggccctgatgtgcctggccgaagccctgctgcgcatccccgacaaaggcacccgtgacgcgctgatccgcgacaagatcagcaccggcaactggcagccacacctgggcaacagcccgtcgctgttcgtcaacgccgccacctggggcctgctgctgaccggcaagctggtcgccacccataacgaagccggcctgacctcgtccctgagccgcatcatcggcaagagcggcgagccgatgatccgcaagggcgtcgacatggccatgcgcctgatgggcgagcagttcgtcaccggcgaaaccatcgccgaagccctggccaatgcgagcaagttcgaagccaagggcttccgttactcctacgacatgctcggcgaagcggcactgaccgagcacgacgcgcagaaatacctggcgtcctacgagcaggccatccattcgatcggcaaggcgtcccacggtcgtggcatctatgaaggcccgggcatctcgatcaagctctcggccctgcacccgcgctacagccgcgcccagtacgagcgcgtgatggacgagctgtacccgcgcctgctgtcgctgaccctgctggccaagcaatacgacatcggcctgaacatcgacgccgaagaagccgaccgtctggagctgtcgctggatctgctcgagcgcctgtgcttcgaaccgcagctgaccggctggaacggcatcggcttcgtgatccaggcctaccagaagcgctgcccgtacgtgatcgactacgtgatcgacctggcgcgccgcagccgtcaccgcctgatgatccgcctggtgaaaggcgcctactgggacagcgagatcaagcgcgcccaggtcgaaggcctggaaggctatccggtctacacccgcaaggtgtacaccgacgtgtcctatatcgcctgcgcccgcaagctgctgtcggtaccggaagtcatctacccgcagttcgccacccacaacgcccacaccctgtcggccatctaccacattgccggtcagaactattacccgggccagtacgaattccagtgcctgcacggcatgggcgaaccgctgtacgaacaggtggtaggcaaggttgccgatggcaagctgaaccgtccgtgccgcgtgtacgccccggtcggcacccacgaaaccctgctggcctacctggtccgccgcctactggaaaacggtgccaacacctcattcgtcaaccgcatcgccgaccagtcgatctccatccaggaactggtggccgacccggtcagccagatcgagcagatggcgaccctggaaggcggcttcggcctgccgcatccgcgcattccattgccgcgcgacctgtacggcagcgagcgcgccaactccgccggcatcgacatggccaacgaacaccgtctggcgtcgctgtcctgcgccctgctggccaccgctcacaaccactggaaagccgcgccgatgctcggttgcgcctccagcagcgaaaccccggcgccggtcttgaacccgtccgatcaccgcgatgtggtcggccacgtacaggaagccacggtcgaagacgtcgacaacgccatccagtgcgcgctgaacgccgcgccgatctggcaggccacgccgccggccgagcgcgccgcgatccttgaacgcgccgccgacctgatggaaggcgagatccagccgctgatgggcctactggcccgcgaagccggcaagactttcgccaacgccatcgccgaagtgcgcgaagccgtggacttcctgcgctactacgcggtgcaggctcgcaacgatttcagcaacgacgcgcaccgcccactgggcccggtggtctgcatcagcccgtggaacttcccgctggcgatcttcagcggccaggtcgccgccgccctggccgccggcaacccggtactggccaagccggccgaacagacgccactggtcgccgcacaagcggtgcgcctgatgctcgaagccggcattccggaaggcgtgctgcaactgctgccgggccgtggcgaaaccgtcggtgcccgcctggtcggcgacgatcgggtcaaaggtgtgatgttcactggctccaccgaagtcgcccgcctgctgcaacacaacgtcgccggccgcctggacgcccagggccgaccaatcccgctgatcgccgaaaccggtggccagaacgcgatgatcgtcgactcctcggccctgaccgaacaagtggtgatcgacgtcgtctcctcggccttcgacagcgccggccagcgttgctcggccctgcgcgtgctgtgcctgcaggaagactccgccgaccgcgtgatcgaaatgctcaagggcgccatggcggaaagtcgcctgggcaacccggagcgcctgtccgtggacatcggcccggtgatcgacgccgaagccaaggccggcatcgagaaacacatccaggccatgcgcgacaaaggccgcagcgtgtatcaggtggcgatcgccgatggcgaagaggtcaagcgcggcaccttcgtgatgccgaccctgatcgagctggaaagcttcgacgagctgcaacgggagatcttcggcccggtgctgcacgtggtgcgctacaagcgcaaggacatcgaccagctgatcgcgcagatcaacgcttccggctacggcctgaccctgggcgtgcacacccgcatcgacgagaccatcgccaaggtgatcgacaacgtcaacgccggtaacgtctacgtcaaccgcaacatcgtcggtgccgtggtcggtgtgcagccattcggcggcgaaggcctgtcgggcaccggcccgaaagccggcggcccgctgtacctgtaccgcctgctgtcgacccgtccgaccgacgccatcgagcagtcgttcgcccgtggcgacgccctgaacgccccggacgtgcgcctgcgtgatgccatgagcaagccgctgaacgctctgcaagcctgggccgacagcaacaagctggcggacctcagcgccctgtgcgtacagttcgcggcgcagtcgcagagcggtgtcacccgcgtgctggcgggcccgaccggcgaacgcaacagctacgccatcctgccgcgcgaacacgtgctgtgcctggcggaagtcgaaggcgacctgctgactcaactggctgcggtcctggccgtgggtggttcggcggtctggccggaaggcgaaccgggcaaggcgctctacgctcgcctgcctgcggaggtgcaagcacgcatccagcgcgtggccgactggaccaaggacgacgtggtgttcgatgcggtcctgcatcacggcgactccgaccagctgcgcgcggtctgccagcaagtggccaagcgtgccggcgccatcgtcggggttcacggcctgtcgcaaggcgaaacctcgattgccctggaacgcctggtgatcgaacgcgccttgagcgtcaacaccgcggcggccggcggtaacgccagcctgatgaccatcggctgaggccgatagtcagcggcatgaaaaagggcgccctcaccggcgccctttttttgcccgatgcaatcccctgtagccgctgccgcaggctgcgataagtcccgcagggacttcggcgacaatgaaatcgctacggccgttccgaccgatcgcagccttcggcagcggctacaggggctgtgcctgtttggcatctttatcacccgcatcaatcttgctgttcagcgtttattcacccgcctagactcggcgcattccctataaagcaggtaggccgccatgtccgagacgttgctcagttcccgcaatctggctttcgagctgtatgaagtcctcgatgccgagggcctgacccagcgcgagcgattcgccgagcacaaccgggaaaccttcgacgccgccctcggcaccgcgcgcagcatcgccgagaaattctttgccccgcacaaccgcaagggcgacgaaaacgagccgcgttatgaagacggcaaggcgatcctgattccggaagtcaaacccgcggtcgatgcctttctcgaagccggcttcctcaacgccgcgcgcagcttcgaggccggcggcatgcagttgccgacgctgttgtcccaagcctgcttcgcgcacttccaggcggccaacgcggcttccacgtcctaccccttcctgaccatgggcgcggccaacctgatcgaaagcttcggtaccgacgagcaaaagcagcgtttcctgcagccgatgatcgacgggcgcttcttcggcaccatggccctgaccgagccccatgccggctcgtcgctgtcggacatccgcacccgcgccgaaccggcggcggacggcacctaccggctcaagggcaacaagatcttcatctccggcggcgatcacccgctgtcggaaaacatcgtacacatggtgctggccaagctgccggacgcgccggccggggtgaaaggcatctcgctgttcatcgtgcccaagttcctggtcaacgacgacggcagcctgggcccgcgcaacgacgtgctgctggccgggctgttccacaagatgggctggcgtggcaccacctccacggcgctgaacttcggcgataacggggagtgtgtcggctatctggtgggcaagccgcaccacggcctgagctacatgttccagatgatgaacgaggcgcggatcggcgtcggcatgggcgcggtgatgctcggctacgccggctacctgtactccctggaatacgcccgcgaacgcccgcaaggtcgcctgccggacagcaaggacccgcataccgcgccggtgtcgatcatccagcacgccgacgtcaagcgcatgctgctgacccagaaggcctatgtcgaaggcgctttcgacctcggcctgtacgccgcgcggctgttcgacgacaccaccaccctggccagcgaagaccagcgcaagcaggcccacgaactgctggacctgctgacgcccatcgtcaaatcctggccctcggagttctgcctgaaggccaacgaactggcgatccagatcctcggcggccacggctacacccgtgaatacccggtggaacagtactaccgcgacaaccgcctgaacccgatccatgaaggcacccacggcatccagtcactggacctcctggggcgcaagctggcgcagaacggcggcgcgggcctcaagcagctgatccggctgatcgccgacaccagcgagcgtgcccaggcccacgacgccctgacggcactgcgccaaccgctggaaaagctggtggcgcgcctgcaaagcgtgaccctgggcctgctcagcgacctcgcccagggcaaggtcaacagcagcctggccaactcggcgctgtacctgaaagccttcggtcatgcggtgatcggctggcgctggctggaacaggcgattcgcgcgcaggaaggcctgaccaggggcaacccggcggatgtgggtttctacaagggcaagctgcaggcggcgcgttacttcctgacctgggaagtgccgtcctgtcatcacgagctggccttgctggaagcgcgggacgatacctgcctaggcatgcaggacgagtggttctgaagtgctaaaagcatcgcgagcaatcgagcgccgcccggctgctcgcgaaaacaatcagtccgacacaaccgcaacggcgttgcaggttgtgggtaaacctatcagttctggctgatggtcttggagatcacttcgaccgtggcgctgacttgctcttggtaacggtcgagctcctgctgatgacgcttttgcatctcgagctgctgggagcacaggttcatcgccgccagcaccagcaagcggtcaccgatcagcgtcgggtatttcttcttggtctcggccagggtggccttcaacatcaacgcggcgtccagcagggtctgctcttccccggccggcgccttgatcgagtagtcctcaccgagaatcgagacgacttttaccccgtcagcaccctgcctcatgcgctgacaggaccggcgctgacgcgctcgaccagggcctggatgcgggccgcggtggcgccttgcttctcttcctgttccatcaggctcagttgcaggctttcgttctcatccttggcctgggccagttctgccttgagggtttcgttcgtgcccgacagttcctggttctgttgcaccaggtcactgacaagctgttccaattggcttagggatgcttccaacattttgattttccgagcatttttcaaagggcgcgtacgataaagaaaagtcaccccggatgccagattttcccggcgcaacgccttgatttgcctggcgggagaccttgcctgcgaactttaaagactgtcattcccccatctggttcctgacacttcgtcgcccatcagatctttctgaaactctcgctcctgcttcaagaatccatttttccgcgcgataggtctggggagccctatcaaccaccgcggcatggattgcgcattctcgaggtagatccccatgtctcttcgcaacatgaacattgcaccgagggcatttctcggctttgcattcatcggctgcctgatgctgttcctgggcatcttcgccctgaaccagatgagcaagattcgcgcggcgaccgtcaccatttccaccgacaacatgcctagcatccagagcatcgatgagttcacccagcagatgttgcgcctgcaagtgctgtcctatcgcctggtgatcaaccgcggtcccgaggtgcaagccaagacccgcgagtcgctcgaactcggcaaccagcagatcgaaaagatccgcaccacctatgaaaagctggtcagcagcccggaggaaagcgaggcctacgaccactacctcaagctgctggccgaataccgcaagctcgaagagcgcatcaaagagctgtcgcgcaacaaccagctgggtgagctgcaagaggtgctgaacaacgagttgatgaagaactcgcagcagatcaacaaggttctgaacctgctggtacagatcaacagccagcgctccaaggacgccaacgagcaggccgccgaggaatacgcttcggcattcaacctggtagtcgccctgctggttctgtccaccaccctgaccgtggtgtttgcctggttgctgacccgcagcattacccaacccatcgccagcgccttgcatgccgcggaacacatcgccgaaggcgacctcacccaaagcatccgggtcaacgggcgcgacgaacccggacgcctgctgcaggccatggcgagcatgcaggaaaaactgcgccagaccttgttgcatatttccggctccgccagccagttggcttccgccgcggaagaactgaacagcgtcaccgacgaaagtgcccgcggcctgacccagcagaacaacgaaatcgaacaggccgccaccgccgtgaacgagatgacctgcgccgtcgaagaagtcgcgcgcaacgccgtgagcaccgccgaggcctcgaacgacgccacccagtcggccagcgaaggccgcaacctggtgcgtgagaccgtcagcgccatagagctgatgagcagcgaagtgcagagttcggccaacaggatcagcgaactggccgaggaatcgcgcgacatcggcaaggtgctggacgtgatccgcggcctggccgaccagaccaacctgctggccttgaacgccgcgatagaagccgcccgggccggcgatgccggacgcgggttcgccgtggtcgccgatgaagtgcgtgccctggcccaccgcacccagcagtccaccagcgaaatcgagcgcatgatcggcagcatccagagcggcaccgagcacgccgtcgagtcgatgcgcaccagcaccgagcgcgccgactcgaccctgagcatcgcccgcggcgccggcggtgccctggacaccatcaacaccgcggtcaacgaaatcaacgagcgcaacctggtcatcgccagcgccgccgaggagcaggccctggtggcccgcgaagtggaccgcaacctggtgaacatccgcgacctgtcggtgcaatcggccaccggcgccaaccagaccagcgatgccagccacgagctgtcacgcctggccgtggacctgaacggcatggtggcgcggttcaccctgtaataagccgccaacagcgctgatcgccacctgcgccagccactacggaacgccatgaagtccgtcggtggccggcgccaggcgacgcttttccgccgcctgtaaacaggcgcaaaagctttttgacagcatcgtatttcaacaggttagaatcgctggcacgcagactgcatggtcagtttgtgcccgcctttctgcttctggagtactgcctttgaatgcgacgaccatcaacagcctgttcttgatcggcgcgttgctggtaggtgcgagcattctggtgagttccctttcgtcccgcctcggtatcccgatcctggtgatcatcctggccgtgggcatggccgccggcgtcgacggtggcggcatcatcttcaacaactatccgacggcttacctggtgggtaacctcgcacttgcggtgatcctcctcgacggcggcctgcgcacccgggtctcgagctttcgcgtggccttgtggcccgccttgtcgctggccaccgtcggcgtgatgatcaccaccggcctgaccggcatggcggccgcctggctgttcgacctgaacctgatccagggcctgctgatcggcgccatcgtcggctccaccgacgccgcggcggtgttctcgctgctgggcggcaagggcctgaacgaacgggtcaccgccagcctggagatcgagtcgggcagtaacgatccgatggcggtgttcctcaccgtgaccctgatcgacatgctcgccagcggccagaccggcctgcactggagcctgctggggcatctgctgcgcgagttcggcattggcggcctgatcggcctgagcggcggctggctgatgttgcaactggtgaaccgcatcaacctggccaccggcctgtacccgatcctggtgatcgccggcggcctggtggtcttcgccctgaccaacgccctgcacggcagcgggttcctcgcggtgtacctgtgcggcctggtgatcggcaaccgcccggtgcgcagccggcatggcatcctgcatatgctcgacggcatggcctggctgtcgcagatcggcatgttcctggtgctgggcctgctggtcacgccccacgacctgctgcccatcgccctgccggcgctgggcctggcgctgtggatgatcctgttcgcccgcccgctgtcggtgatggtcggcctgttgccgttcaaggccttccacggccgtgagaaagcctttatttcctgggtcggcctgcgcggcgcggtaccgatcattctcgcggtgttcccgttgatggccgggctgcccgaagcccagctgtacttcaacctggccttctttatcgtgctggtgtccctgttggtgcaaggcaccagcctgccgtgggtcgccaagctgctgaaagtcacggtgccaccggagccggcgccgatctcccgcgccgccctggaggtgcatgtcaccagcgaatgggagctgttcgtctaccgcctcggcgcggaaaaatggtgcatcggcgcggcgttgcgcgagctaaaaatgcccgaaggcacccgtatcgccgccctgtttcgtcaccagcaactgctccatccgtcgggtagtacggtgctggaagccgacgatttgctctgcgtcatcggccatgaacacaacctgccggcccttggaaaactcttcagccaggcgccgcaacggggcctcgatctgcgcttcttcggcgacttcgttctcgaaggcgacgcccagctgggcgcggtttcggcgctgtacggactcaagctcgaagggctcgatccggacatgccgttgagccgcttcatcacccagaaagtggggggtgctccagtggtcggcgaccaggtggaatggaacaacaccatctggacggttgccgtgatggaggggaacaagatcagcaaagtgggcgtcagattccccgaaggaagtcgcccgggccccggactcttcctctaaactgcctaacttctcatccagcttgaccggtctctatgccaaccctgcgtacccttttcgccattgccctgctgggcctgagcctttctgtcggcccactgcaagcggccgagccgcccagtgccgagtccgtccagcagagcctggataaaatcgccgagcgcaaattgccggaggccgatcaaaaggccctgcaagcggtgctgcaacagacgctgaccctgctgtcgaacaagcaggattacgaacagcgcctgaacgacctcaagcagcagctgagcaatgccccacgccagaccagcgaaaaccagcgcgagctgacccgcctgaaagccaccaaggtggtgccggtggcccagcgctacgccaacctgccagtgtcgcagctcgaacaactgctgaccgaacgcaccacccagcagggtgacatgcagaaagccctggccgaggccaacagcctggccattaccgcgcagacccgccccgaacgcgcccaggccgagatcagcagcagccagacccgcacccagcagatcaatacgatcctcaagaacggcaaggactccggcaagccgatcaacgccgaccagcgcaatcagctcaatgccgaactggcggcgatcaatgcgctgatcccgttgcgccgccaggagctggccggcaacagccaactgcaggacctgggcaacagccagcacgacctgctgatggaaaagaccgcgcgcctggagcaggaaatccaggacctgcagaccctgatcaaccagaagcgcctggcccagtcccaggaaaccgtcacccagcaatcgatcgaagcgcaaaaggccggcagcagcagcctcctggccactgaaagcgcggccaacctgaagctctccgactacctgctcaaaagcaccgaccgcctcaatgagctgacccagcagaacctgcagaccaagcagcaactcgacagcgtgacccagagcgatgccgcgctggacgagcagatcagcgtgctcaagggcagcctgctgctgtcgaagatcctctataaacagaagcaggcgttgccacacctgcggctcgaccgcgacctggcggaccagatcgccgacatccgcctgtatcagttcgaggtcaaccagcaacgcgaactgatcagcagcccgagcagctatgtcgataacctgctggcgacccagccgtccgagcaagtcaccccgcagttgcgcaaaaccctgctggacctggccatcacccgtgccgacctgctggaacgcctgagccgcgagctgagcgccctgctcaacgaatccatcaccctgcagctcaatcagaagcaactgctgagcacctcgcaaagcctgcgcgcgaccctcgacgaacagatgttctggattcccagcaacaagccgctggatgccgaatggctgcaaaccataccgctgcgcctggaaaaacaggtcaccaccctgccctggtcgtccagcctgagcgagctggccgacggcctggcgcaacggccgctgctgttcctgccattgctgctcctgatcgcggccctgctgtggcggcgcaagaacctgtacctgcgcctgaccaaggttcacaaggacatcggtcacttcaagcgcgacagccaatggcacacgccgcaggcgatcctggtcaacatcctgctggcgatgccggtcgccctcggcctggcgctgtgcggcctggccttgcagatcgacgcccgcggacagaacgccaacctcggcgcagcgctgttgcagatggcccaggcctggctggtgttctataccgcctaccggatcctcgcccccggcggcgtggcggaactgcactttcgttgggaaaagccccaggtcgagttcctccagggctggatccgccgcctcgggctggtggtcatggccctggtggccgtggtcgccgtggccgaacatcaaccggcggcactggccgatgacgtgctcggcatcgccgtggtcctgacctgctacgccctgatggcctggctgctcagccgcctgctgctgagcagcccgacgcaccagaacgcctcgctgttccgcaaggcggtggcggtgctcttcaccgcgctgccgatcgccttgttcatcgccgtgtgcttcggctactactacaccgcgctgaagctcagcgaccgcctgatcaataccctgtacctgctgatgttctggctggtgatcgaagccactttcgtccgcggactgagcgtcgccgcccggcgcctggcctaccagcgcgccctggccaaacgccaggccgccaaggaaagcggcgacggcgaagcggtggtcgaagagccgaccctggacatcgagaaggtcaacgaacagtccctgcgcctgatccgcctggccctgctcggtggtttcatcgccgggctgtactgggtctggtccgacctgatcagcgtgttctcctacctggacaacatcaccctctacgaatacaccagcggcaccggcgccaacatgagcatggtgcccatcagcatcggcgacatgctcggcgcgctgatcatcgtcggcatcaccttcgccctggcgcgtaacctgccggggctgctggaggtgctggtgctgtccaggctgaacctggcccagggcagcgcctacgcgaccaccacgctgctgtcctatgtgattgccggcgtcggcttcgtctcgaccctgtcgaccctcggcgtcagctgggacaagttgcagtggctggtggccgcgctgtcggtaggcctgggcttcggcatgcaggcgatcttcgccaacttcatctccggcatcatcatcctgttcgagcggccggtgcgcatcggcgacaccatcaccatcggcaacctgtcgggcacagtgagcaagatccgcatccgcgccaccaccatcaccgacttcgatcgcaaggacatcatcgtcccgaaccaaaccttcatcaccgggcaactgatcaactggtcgctgaccgacaccgtcacccgggtgaccctcaagctcggcgtcgactatggctcggacctggacctggtcaaggaactgctgctcaaggcggcccgcgataacccgcgggtactgaaagaacccgagccccatgtgtacttcctcaacttcggcgaaagcaccctggaccacgaattgcgcatgcacgtgcgcgagctgggggaccgcaacccggtgctcgacgaggtcaaccgcttcatcaaccgcgagttcaagaaacagcacatcaacatctcgttccgccagatggaggtctacctgaagaacctccatggccaggaatacaagatggtgcccatcgagccggagaccaagaccattgttccgctgcccgacggcaaaccgctgcaggaaccgcctcccagcaggctcgactaaggacgctatccctagcagaatgctcggacattctgctggagatggccgttgaaagccctcgacgaactgaccttcgacaatcgcttcgcccgcctgggcgatgcgttctcaacccatgtactgcccgagccgatcgaccgcccacgcctggtggtggccagcccggcggccatggcgctgctggacctggaccccgaggtcgcgcaaagcccggtattcgccgaactgttcggcgggcacaagctgtgggccgaagcggagccccgggcgatggtctattccgggcatcagttcggctcctacaaccctcagttgggcgatggtcgcggcttgctgctgggcgaggtgtacaacgccgccggcgagcactgggacctgcacctcaagggcgccggccagaccccctactcgcgcatgggcgatggccgcgccgtactgcgttcgtcgatccgcgagttcctggcttccgaggcgctgcacgccctgggtattccaaccacccgggcgctgtgcgtgatcggctccgacaccccggtctggcgcgagaaacaggagcgcgcggcgatgctgctgcgcatgtcgcccagccatgtccgcttcggccacttcgaatacttctattacacaaaacgccccgagcagcagaaacagctgggcgagcacgtgctggccatgcactttcccgcgtgcctggagcagccggaaccttacctggcgatgttccgcgaagtggtcgagcgcaatgccgaactgatcgccaaatggcaggcctacggtttctgccacggggtgatgaacaccgacaacatgtcgatcctcggcgtgaccttcgacttcgggccattcgccttcctcgacgacttcgatgcgcatttcatctgcaaccattccgatgaccaggggcgctactcgttcagcaaccaggtgccgatcggccagtggaacctcagcgccctggcccaggcgctgacgcctttcatcagtgtcgaggccctacgggaaaccctcggcctgttcctgccgctgttccaggcccattacctggacctgatgcgccgccgcctcggcctgaccagcgccgaagacgaggatcagaagctggtggaacggctgctgcaactgatgcagggcagtggtgtggactacagcctgttcttccgccacctgggggatgagtcggcggaactggccgtggcccggctgcgcgacgacttcgtcgaccgccagggcttcgatgcctgggccgatctgtataaagcccgggtcgcccgtgatccggtccagggtcaggagctgcgccgggaacgcatgcacgccgtcaacccgctgtacatcctgcgcaattacctggcacagaaggccatcgacgccgccgaacaaggggattactccgaggtgcgccgcctgcacgcggtgctgagcaagccgttcgaacaacaggccggcatggacagctacgccgaacgaccgcccgaatggggcaagcacctggaaatcagttgctcgtcctgaggggtcagataaaggtttccatcgagaccttgaaacgttcggccagccagcggatctgacgcaggttgagctgacgcttgccgctcaggatctccgagactaccgactgcgcgccgacaccgggcaggtcgctctgggtcagaccgtgttcgcgcatcatgtagcgcaacacatctattccgctggcaacaggcatcgggcgatgttcaagatcgtaggcttcgatccagtccccgatgatgtccaccaggctgttgagaggatgggcctcatcttcccctgtcaggtccaacaactcgtcaagggcctgaaccagtctgtcgtagtccgcctcggttttcggcttgcgcagcaacggcgcaacgaactgccagtgttcggccacttgctcgatcaatgcactcatcctcgatcctccttccacttaccccggtcatattcacggtggtccaacacatggcggatatagagcttttgcgtcgtataacggaccaatgcaatcagccgtatcttgttgccaccgatatcgaacacatgcagcggtccgaccttgtccaccgccggaaacatcgccttcatcgcggcaaaatccgcaagccgattgcgtttaagcgcgcgataccaatcatccaacgccttggccgactgtggccatttttccttggcatcccaaattcgtttagccgtgattacacgcatgcaaagtccttatcgcatactgctatagcagcctagagggtgaagcaacttatcgcaagttgctataaatgctctcggaccaatggcacggagcatcgtctctctccagcctagaaccgagccgacggttgccgcgcaaagatgtatgagcgcatgcaacagcttgataaaccggcccacagcctccagatcggagctattggccacttatcccggagcccctcatgtccgatccactgctaatcccctgccctcactgcaacggcctcaaccgcatccccgccgagcgcctgggcgatcagcccaaatgcgggcgctgcaaaggccaggtgttgctgaaccagcctttcgagctgaaacaaggcgactattccagccagatcaagggcgacctgccgttgctggtggatgtctgggcggattggtgcgggccgtgcaaatccttcgcgccggtgttcgagcaggcggcggcgcaattggcaggcaagtgccggctggccaagctcgacagcgaggccaaccagcaattgtcggcgcagttgggaattcgctcgatcccgagcctgattctgttcaagaacggacgggaagtggcacgccagagtggcgccttcccgttaccgcaactgatgagctggctgcgcagccagggcatctgaccgctatttcaaaagtgccttgaaccctaggaagaaggtcaggcgctttccagcaggttgtgcaggtcgacgaactgctgggtcagtttgtgccgggggtcgaggtggatcagcggcaggctggcctggtgggattcgcgcatgcgcaccgaactggccaggtacaccggcaataccggcaggccctcggcgatcagttcatcgagcatttgctggggcaggctggcgcgggcctggaactggttgaccacgatgccttcgacctgcaagtcctcgttgtggtcgtccctgagttcttcgatttccgccagcaggccgtacagcgcctggcgggaaaagctgtcgcagtcgaagggaatcaatacgcgatcggcggcaatcagcgccgaaaccgcatagaaattcaaggctggcggggtgtccaggtagatccggtcgtagtcctcggccaactcgtccagcagtttgcgcagcttgttgatcttgtgcttcgcctcaagcttgggctgcagatccgccagctcggcggtggccgtcaccacatgcaggttgtcgaacggcgtttcgtagatatcgacctgattcttcttcgagaacggtccggaagacagggtctgcttgaagaagtcggcgatccccatggggatgtcgtcgccggtcaggccggtgaggtattgagtggagttggcctgggcatccaggtccaccagcaacgtgcgatacccctcgctggcacttacggccgccagattgcaggcaatgctcgacttgccgactccccctttctgattgaacaccacgcgccgcatgtcagaacctccctgcatcaaagatcaccgagtgtagtagccagtaccgccgcttcgctacctcgctgacggcagaccgccaaaccagttccagcggccagaatcagcctagactttcttgtaaagtccccgcgcgcccgacctgtaccattcgataatggccaaatgacacttttctgccgtcgagcgggtcattttcactgagcgaaacataaccaatgtttgctacaagccagtcacaccgggataatgcgcgccactcggctgtagctccgtggcaggtgagtctgcgatcgaaacgcctgaccacgtcaagtaagcccgcaggggcgggatgaattttcaagtgatcaacttcaacatcgcccaatggcgcgcgtgggcccctgggctcgaaagcgtggacgattggcaggcctggagccgacagccggtcgtgctccagagcagtgatgcggccccggacgtgtcgtttctaccggccatgcagcgccggcgcctcagccgtctggcgcgcatggccttcagcgtaggctggccgctggccgaaggcctggaacagctaccgttggtctttatttcccggcatggcgaaacgccgcgcaccttcgatatcctcagcgacctggcggccgaccagccgttgtccccgacccagttcagcctctcggtgcacaacgcggtgatcggcctgtggtcgatcatgcgtggcgaaaccagcgaaatgaccgccctcgccgctgccggcgacggtctcgaacacggcatgctagaggccgcggcgctgcttggggaaggcgccccggcggtgctgctggtggtcaccgaagagcagccgcccgccgcctatgccacctggatcgacgacgtgcccttcccctatgcggtcggtctgttgctgacctccggccagcagtggcaactgacgctcggcaccgccaccgagggagcgccgcgcgccgagtggccccatgccctgaatctcttgcgtaccctgctcggcgagcaaaccttttgccaacatgcctggaagaaccgtgtatggaactggcaacgcaacctgtaaatacaaagccccgcgacgcctactactggcgtctgatcgccaccgcggcaagcttcgccttgttcggcctgggcggcctgtgcctgcgcctggtgattttcccgctgctcgcctgcctgcccggcgacgccgaagcgcatcgccagcgcgcgcgtcgtaccatcggccggctgttctggctgttcatccgcttcatggcccgcagcggcgtgctgacctatgaagtcgaaggcgcacaaaagctcggccgccccggacaaatgatcattgccaaccacccatcgctgatcgacgtggtctttctcatcggcctggtgcgcaacgccaactgcgtggtcaagcagagcctgtggcagaacccgttcactcgcggcccgatacgcgaagccgaatacatcagcaacgacggcagcatggacatgctcgacgccgccggcgaagccctgcgcaacggccagaccctggtgatcttccccgagggcacccgcacccagccgggccaggcgccggcctttcatcgggggggcgcggcaatcgccttgcggggtgcgagaatcatcaccccggtggtgatcaaggtcagcccgaccaccctgaccaaggccgaaccctggtatcgcatcccgatgcgccgcgtgcacttcagttttcgcgtcggagccgatatagacccgtatgcctttgccgcccaaggccccgcgccgcaggcctcgcgcaagctcaacgattatttgcatcactacttcattaaggagctcgccgaagatgagcgatctgcaccaggaaattaaaatgctgatcatcgatgccctgggcctcgaagacatcagcgtgcaagacatcggcaacgagcagacgctcttcggtgaaggcctgggcctggactcggtcgacgccctggagctgggcctggcgatccagaaacgctacggcatcaagatcgacgccgacgccaaggacacccgcaatcacttcaccaacgtggcgagccttgcggcgttcgtcactgcaaaacaggcagcttgagaccggaccatgcaaactcgtgacgacatcttcaacaccctgcgtgatgccctggtggaactctttgaactggaaccggaacgcgtaagcctggaatccaatctgtatcaggacctggaaatcgacagcatcgacgccgtcgacctgatcgatcacatcaagcgcaagaccggcaagaaaatcgccgccgaggaattcaagtcggtgcgtaccgtcaatgacgtggtcgaggcggtataccgtctggtccagccggccgcatgagccggctgatcggccttggcctgctgctggcgggcctgttgtatccctttgcggtgtatttcggcatggagcatttcgctccctggcagttcggcctgttgctcggcggcctgtggctggcccgggcgctgaccggcgaacggcgtcccggcagcctgtggatggcgggcgccgccctggttttctgcctgctgctggcgctgttcgataacccgttgttgctgcgctggtacccggtgctgatcagcggcttcatgctcacgctgttcggcctgagcctgaaatacggcccgccggtggctgaacgcctggcccgcctcagcgagcctgcgctgccggaaaaggcgattcgctatacccgccaggtgactgtcgcctggagtgtgtttttcctctgtaacggattgctcgccgcggccctgaccctatgggcgccgctgagctggtggacgttgtacaacggcctgatctcctacgggttgatgggtttgctgtttgccattgaatggctgttacgacaacgcgtacgaggccgcgcatgaattggataaaacttgagcagttgctgctcaagtcgttgccggaacgggccgtcacgctcgaaccagcactcgatcacagccacctgcggcaccaggccctgagcctggccgcgggtttgcaggccaggggcgtacagcgcctggccctgcacctggaagatgccgccgaactggccatcgccctgctcggtgcctggcgcgccggggtcagcgtactgctgcccgccgacctgcaaccgcagacccggcaacgctgggcgacgcaggtcgatctgtggctgaccgaccagccgggcgatgcccacttggccgacttcgaccagccgccattgcccgccgtcgaactcgatctcgacggctgccgcctgagcctgtgcacctccggctccagcggcgaacccaagcgcatcgacaaatccctgcgccagctggccaacgaagtcgaggccctggaacaactgtggggcgagggattgggccaggcctgcatcatcggcagcgtcgccacccaacatatctacggcctgctgttccgtgtgctctggccgctctgcgccgggcgcaccttcgtccgtcggcagttgccgttcccggaagacctgcagcgcgccagccgcgaacacccggcctttgcctgggtcgccagcccggccttgctcaagcgcatgggcgacaacctcgactggccggccctgagcccggtgcgccgggtattttcctctggcggcgcgctgcctgccgacgccgcgcaaggcctgcaccagcgtcttggacaatggcaacggaaatcctcggtagctcggaaaccggcggcatcgcctggcgccagggcgacagcctgtggcaagccttcgccggggtcgagctgagccaggacagcgacggcgccctgttgatcgcctcgccctacctgccgaccgggcatatcgaacacaccgccgatgccgcgcgcatcaccgccgatgggcgtttcgagctgctcgggcgcctggaccggatcgtcaagctggaagaaaaacgcatttccctgccgatgctggaacaggccctggccgagcatgcctgggtcgccgaagcgcgccttggggtggtccgggaaaaccgcgcttccctcggcgcgctgctggtcctcagcgaacaaggcctgcatgccttgcgcaatcagggtcgtcgggccctcacccaagcgctgcgccagcacctgagccagcattgcgaggccctggcactgccgcgccgctggcgcctgctgcgccagttgcccctgaacagccagggcaagctgccccaggccgatgtcgaagccctgctgctggccccgcgcccacgggcgccggaagtgctggaacagctcgaggccgacggcgaatggagcctgcaactggcgatcccaccggacctggcctacttcagtggccagttcccccagaccccggtgctgccgggcgtggtccaggtggactgggcattggcgctgggccagcagttgctcgatctgccggggcgctttgccggcatggaagtgctgaagttccagcaactggtgcgccccggcgaccaggtgcaattgcacctgcgcttcgatcatgagcgcggcaaactctacttcgcttatcgcaatgacaccgccgcctgctccagcggccgcatcctgctggagaacgcctgtggataagttatgggcgccaggcgagcgcagcccccagcggctttttgtagccgctgccgaaggctgcggtcggccgcacagcggacgcctgggaggcaactcccatgcataacccttgcgccgtcatcccggtctacaaccatgaagccgccgtgccggcggtggtcgaggccctgctcgccagcggcctgccctgtgtgctggtggacgacgccagcagcccggcctgcgccgccgtgctggaacagctggccgagcgcgaacaggtattcctggtcaagcttgcggtcaaccagggcaagggcggcgcggtcatggccgggctgcgcgaagcctcgcgcctgggtttcagccacgccctgcaagtggacgccgacggccagcacgatctgcgcgatgtggataactttatcgccacctcccgcacccaccccgaagcgctggtctgcggttatccacagtacgacgccagcgtacccaagggccgtttttacgcgcgctacctgacccacgtctgggtctggatcaataccctgtcgttgcagatccccgactccatgtgcggcttccgggtctaccccctgccgcccatcctggcgctgatcgactcggtgaagatcggccagcgcatggatttcgacaccgatatcctggtgcgcctgtcctggcgcaaccagccgatgcgctggttgccgacccaggtccgttacccggcggatggcctttcgcactttcgcctgttccacgacaacctgctgatttccagcatgcacgcccggctgttcttcggcatgttgctgcgcgcgccgctgatcctctggcgacggtggcaagcatgacggcgctacacgacaagcaggacaagcaacattgggccgagcacaaagagcgcggcagcttctggctgatgaagctcaccgccttcggcgtgcgcgtgctcggccgccgggtgttgagcccggtgctgtacatcatcgtgttctatttcttcctgttcggccgcggtgcccgccgcagcgcctggttgtaccagcagcgcctggccgactggagcggcaaggccgaactgcgtcccagccactggcgggtattcggccagttcatggcattcgccgattccctgctggacaagctcgacgtgtggaacggcaagctgcgcctggaacagatcgagatcgtcgacccggcccggctgcgcgaccagttgcgcggcacccgcggacagatgctggtgggcgcgcacctgggcaacctggaagtctgccgcgccctggccgagctggacgagaaggtcaccatgaacgtgctggtgcacaccaagcacgccgagcgtttcaatcgcctgctgggcgaggccggagccaccaacctgcggctggtccaggtcagcgagctggatccggcggtcatgctgcaactgagccagcgcctggatcgcggcgaatggctggcaattgccggcgaccgcgtaccgctgcatggcgggcgcaacgtgcgggtggatttcctcggccatccagcccctttcccacaaggaccgtggctgctggcgggcctgctgaaatgcccggtcaacctgctgctgtgcctgaaaaacaatggccgctatcgagtgttcctcgaacccttcaccgaggccgtggcgtggaagcgcagcgaccgcgaacaggtcatcgcccagtggactgcccgctacgccgagcgcctgggccagtactgcctcgaagcgccccaacaatggttcaacttttaccctttctggaagaccgatgacgacgcatccgcttgagccggtaaccttcggcgaactccctttgcgcatcgaagacgtgctggccctggccaaccgtcaggcgccgtcccgactgcaaggcgacagcgcattccgccagcgcatcgccaagggcgcgcaattcctcgattcgctgctggacaaggaaggcgtgatctacggcgtgaccaccggctacggcgactcttgcgtggtcgcggtgccgctgcaacacgtcgaggcgctgccccgtcatctgtacaccttccacggctgtggcctgggcaagctgctggatgcgcaagccacccgcgcggtgctggcggcgcgcttgcagtcgctgtgccatggcgtgtccggggtgcgcgtggaactgctggagcgcctgcaggcgttcctcgaacacgacatcctgccgctgatcccagaagagggttcggtgggcgccagcggcgacctgacgccgttgtcctacgtggccgcgaccctgtccggcgagcgtgaggtgatgttccgcggcgagcgccggacctcggccgaggtgcaccgcgagctgggctgggagccgctggtgctgcggccgaaagaagccctggcactgatgaacggcaccgcggtgatgaccggcctggcctgcctggccttcgcccgcgccgactacctgctgcaactggccacgcgcatcaccgcgctgaacgtggtcgccttgcagggcaacccggagcatttcgacgagcgcctgtttgccgccaagccgcacccggggcagatgcaagtcgccgcctggctacgccaggacctggccatcgacgcaccgaccgcgccgttgcaccgcctgcaggaccgctactcgctgcgttgcgcgccccatgtgctgggcgtgctggccgacagcctgggctggctgcgtggcttcatcgagaccgagctgaacagcgccaacgacaacccgatcatcgacgccgaagccgaacgcgtgctgcacggcgggcacttctacggcgggcatatcgccttcgccatggacagcctgaagaacctggtggccaacgtcgccgacctgctggatcgccagctcgcgctgctggtggacgagcgctacaaccacggcctgccgagcaacctgtccggcgcccccgcggaccgcgccatgatcaaccacggcttcaaggcggtgcagatcggcaccagcgcctggaccgccgaagcgctgaaaaacactatgccggccagcgtgttctcgcgctccaccgaatgtcacaaccaggacaaggtgagcatgggcaccatcgccgcccgcgatgcgatccgcgtgctggagctgaccgaacaggtcgccgccgctaccttgctggccgccaaccaaggcgtctggctgcgtggccgagccgaggacgcgcggccgctgccgccggccctggcggccatgcacagcgagctggccaaggacttcccgccagtgatcgaggaccgcgccctggaaggcgaactgcgcctgtgcctgcaacgcattgccgagcaacactggaggctgcatgcgtagtcggggcgtgctgcacgcggacaccgagatccaggtgccgtttttcgacgtcgacaccatgcatgtggtctggcacgggcactacgtgaagtacctggaagtggcacgctgcgccctgctcgacaagctcggccacaactacaaccagatgctcgaatccggctacgcctggccggtgatcgacctgcaattgcgctatgtgcgcggcgcggtgttcggccagaagctcaaggtccgcgccagcctggtggaatgggaaaaccgcctgaagatcaactacctgatcagcgacctggaaaccggcgaacgcctgacccgcgccagctcggtgcaggtggcggtggagatcgccagccgcgagatgcaactggcctcgcccaaggtgttcaccgatgccgtcgagagatcgctgccatgacgcgtccgcttcctgtaggagcgagcttgctcgcgaaaatcgtcaatccttacgcacattacctgacaccccgcggcgccctgcgttctttcgcgagcaagctcgctcctacagtgttcgtgctgttggggatgccgggcctggccaatgctttcgacctgcaacagctcagcgaccagctggccaagcccgaggtgatccacggcagcttcgtccaggagaaacacctgcgcgccctgccccagccgctgaccagcaagggcagcttcgtcctggcgaagaaccatggcctgctgtggctgctgaaaacaccgctgcaacaggactaccgcatcaccggccaaggcatcgcccgccgggacggcagcggctggcaaatgctgccgaacaagagcgccggggccgaacagaaccgcctgttcctcgccgtgctgcaaggcgacagcagcggcctgcaacgggacttcgagctggccctggccggcgacgccaaggcctggaaactgaccctgaccccacgttcgctgctgctcaagcaggtgttcaaccagatcaacatcgacggtggcgaactggtgcaacgcatcgagctgctggaaacccagggcgacagcaccgtgctgaagatgcacgacagcatcagcaaccagcccttgagcgacgcggagcaacatgactttgccgagtgaacgctggtggccgcggctgttcctgctcctgctggtggccgtgctggccctggccggctggcaatggcgtcatggcgcgccgctgtcggccaacctcatggagttggtgccgggcactgaccccgatgccctggagctcaaggccgagcagcgcatgcaggagccgctgaaccgcgaaatgctggtgctggtgggccacgccgagcgccaacaggccatcgccatggcccagcgcctgggtgaacaatggcaggccagcgggctgttcgagaaggtccagtggaacctgcaggccgacctgccggcgctgcgcacacaattgctgcaagggcgcctggcaatgcttggcgccgccgaccgccagcagttgatcgagcaccctgacgtctttatccagcagcgcgtccaggcgctgttcgaccccttcaacagtttcagcctggtcccgagccaggacgactggctgggcctgaccggacgcatccagaacagccagccgcaacgtggcgcggtgcaactggacatcggcagcggcaccctggtcgccgatgccgacggcaagagctgggtgctgctgcgggcgcgcaccaccggcaacgccttcgacatgcagctgccactgcaggtggcggccctgctccagcacagccgcgaacaggccgccgaggccgacgtccagctgctggccgccagcggcctgctctacgccgccaacggccagcaacaggcctcccgcgagatcacctgggtcggcggcggcgccaccgtcggcatcctcctgctgctgttgctggctttccggcgctggcgggtgttgctggcgttcgtgccggtgctggtgggcatgctgttcggcgcggtggcctgcgtcgccctcttcggccatatgcacgtgatgaccctggtgctgggttcgagcctgatcggcgtcgccgtcgactacccgctgcactacctgtccaagagctggagcctgcgcccctggcacagctggccggcgctgcgcctgaccctgccggggctgaccctgagcctggccaccagttgcatcggctacctggcattggcctggacgccgttcccggccctgacccagatcgccgtgttctccgccgccgggctgctgggtgcttatctgagcgcggtgtgcctgttgccggcgctgctgcgcggcgtcgagctgcaaccggcgcaatggccgctgcgcgtagccgaatggctgctaaacctgcgcacgcaattgctcaagcgcgtgtccagcccctggctgctggcgctggtgatcgccttctgcgccggcggcctgtggcagctggagagcaaaaacgatatccgccagtggatcggcgcgccgccacaactgctcaacgaagcccaggccatcgcgcggatcaccggctaccagcccaccagccagttcttcctggtgcgcggcgccgatcagccacagctgctcgaacgcctcggcgccctgagcgagcgcctggagcaactggtcaacctggagaaactccagggctacctgtcgctcaaccagctggtgagcctgcccagcgagcaacagcgcctgcgccaggccctggacgagctgccgcggcactggcagccactgctggatctcggggtaccggtggcggccctgaacgcggaactcgcgcaattgcgcgcgctgcccagcgaagacatcgacgcggccctgcaaggcccgctggccgagccttaccgcaccctgtggctgggccccaccgataacggcgtggcggcgatggtcagcctgcaggggctgaacaacccacagttgctgcggatacaggcgcaggatctgccaggggtgcaactggtggaccgcctgggcgacctgaaccaagtgttcgccgccacccaggtcagcgccgccgagctcaagctcgcttcctgcgtgctgatcgttgtgctgctgatcctgccgttcggcctcggtggcgccctgcgcctcgtcgccctgccgctgctggcagccctgtgcagcctcgccagcctgggctggctggggcaaccgctgaccctgttcagcctgttcggcctgttgctggtgaccgccatcagcgtcgactacgccatcctcatgcgtgaacaggtcggcggggccgccgtgagcctgctcggcaccttacttgcagcgctgaccacctggctgtcgttcggcctgctggcgatttccagcaccccggcggtcagcaacttcggcctgtcggtgagcctgggcctggccttcagttttatcctggcgccctgggccggtcgccagcgccatcggcagcccgttacggagcccgtcctgtgatgaccgccctgttctggctcatggcgctgctgctgttcgcgctcgccacccgtatcggcagccgtttcggcctgatcccgatcgtcagccagttgctgctggcgaccttcggcctgccgctgctgatgctgttctggatcgagccgcactggcagctgagtggcgcccaactggtctcgccgacctggctgaagaacctgtacggtttgagtttcgccctgctgctggggcatatcctcagcgacgtgatcgacctgcgcctggaccgccagagcctgaagatcgccctgccgagcttcgccatccccttcgcctgcggcctggccacggcggtctggctgttgccggcgcaaccctggctgagctccctggcggtgggcctgctgttcgccattaccgcgattccggtgctgtacctgtacctgcggcacatcgactacccaccgctggccacccggcgcctggtacagaccgcgatcctcatcgacctcagttgctggaccctgttcggcgtcgcccagggcagcctgcacctgagcagcctgctgctaccactggccgcagcctgcctgccgctgctcctgcgcggcctcggcctgcgccagccgctgctgcacagcctgggtttcttcggcctgttggtggtggccgagcactacaagctcaacgcgctgattttcggtatcggctacctgctgtgcatggccgccctcaaggtgccgctggtgctgccgttaaaggcagcctggatgagccgtttgcagacctttatcgccatcccgctgatccttacgttcggcatcgtgcagatcaacgtgcacagcgccatggacagcctcggctgggtgcagctgggggccttgctgctgttgccgattgccagcaagctgctcggcaactggctcggcctgggctgggccggcgcctccttcaagggcgccagccgctggcgggaaagcctgctgctgaacattcgcgggctgagcgagatcgtctttctcaacctgctgctgcaacaacagctgatcagcccggcgctgtacttcgcgctgatgctcatgggcctgatcgccaccctgatgccggccctggccgggctgcaccgaacacctttggtccctttgaacccgaacatcgccgaaccggcaaggagccccagtgccaacagttgaaatggaacgccgccagattgtggtgatcggcgctggcccatcgggcgccattgccgctgcgctgctcaagggcaaaggccacgacgtgctgatcgtcgagcgccagcatttcccacggttttcgatcggtgaaagcctgctgtcccactgcctggatttcgtcgaagaggccggcatgctcgaggcggtcaacgccgcgggcttccagcgcaagaacggcgccgcgttcgcctggggcgagcgctacagcgcttttgatttcggcgacaccttcagcgaaggcaagcccaccacctttcaggtgcaacgcgccgacttcgacaagctgctggccgatcaggccgccctgcaaggcgttgaagtgcgttatggcgaggccatcgtcagcgccgacttcagcctggccaggccgcagttgcaggtcctgcgcgaagacggcagcgagtaccgggtggaagcggacttcgtcctcgacgccagcggctacggccgcgtgctgccaggcctgctggacctggaggcgccctcgaacttcccggtccgccaggcggtgttcacccacattgaagaccgtatcgacagcccggcctttgagcgggaaaagatcctcatcaccactcaccccagcaaacgcgacgtgtggttctggaccatcccgttcagcaacgggcgctgctcggtcggcgtggtggcggccaaggagcatttcgacggccgtggcgacgacctggaccagtgcctgcgcggtttcatcgaggaaaccccgagcctggccaaggttctgcacaacgccgtctgggacaccccggcgcgggccatcggcggctactcggccaacgtcaagaccctgcacggcccgggcttcgcgctgctgggcaacgccgcggaattcctcgacccggtgttctcctccggcgtgaccatcgccatgcgttcggcgagcatggccgccgccgtgctgcatcggcagttgcagggcgaaagcgtggattgggaaagcgaattcgccatccccctcaagcgcggcgtcgacaccttccgctgctacgtcgaaggctggtacgccggcaccttccaggacgtgatctaccacccgggcagctcgccggaaattcgccggatgatcagttcgatcctcgccggttatgcctgggacgaacgcaacccgttcgtcagcgaacccaagcgccggctgcgcatgctctcggaaatctgcgccatggaggccccatgaacgacgcccagccgcagtacctgagcgccagctacgtcgaggaaacccgcttcggcttctggttcctgcgcagccatacctggcagcaccatgtgctacgggtggcgatcaacgacctgcgccgcctgttcgacaacgagccgccgagcaacccggtgctgctggatgccggctgcggccagggcaagtcgttccagtacctgcgccaggtgttcgccccgcggcgcctgatcggcctggacgccgacccgcgcagcctcaggctcagcagtgaagaagcggcgcgccggggcttgcaggtcgagctgatcggcagcgactgcgcgaccctggacgtggccgatgccagcgtcgacctgctgttctgccaccagacctttcaccacctggtggaacaggaaaaggccctggccgagttctaccgcgtgctcaagccgggcggttacctgctgttcgccgaatccaccgaggcctacatcgacacctgggtgatccgctggctgttccgccacccgatgcacgtgcagaaaagcgccgcgcagtacctggaaatgatccgtcgacagggttttgaattcatcccgcgcaatgtgtcttatccctatctgtggtggagccgtgccaaggatttcgggctgctcgaacgcttcggcctgcgccgcccgaaaccctttggccaacgggaagaaaccctggtcaatgtggttgcccgcaaacccctgcacgaaggtgccgctggatgatccgtgccctgctcgtcggctgcctgctgttgctgagcgcctgcgccagccagccgccgctgcccgagaaaaccccgagcctggccctgccgctgcaactgcacgtcgagcggcaacaggccgggcagcgccaggactggctgctggtgatccaggccgaagggccgggcatccgctggtcgctgattgacccgctgggcattcccctggcgcgccagcaactgatcgccggtcgctggcaggccgacggcctgttgccgccgaacccggaggcccgcgaactgttcgccgccttgctgttcgccctgacgcccgcgggcgaactgcgagataattatccagccgcccggcagcacggcgcgcagcgtgacctcgccccgcactggcaggtccgctatcgccaggctctggacttccgtctggagttgcctcgtggcttgcactaccacatcagcccgctgaccgccgagaacgcctcatgacggcctacctgaatgccctcggggtgatctgtgccctggggcgcgacaagcagcaagtggcccgcagcctgtttgccggcgactgctccggcatgcgcgccgcagccggctgggtgccggagcgcagcgtgcccgtggccgccgtccaggggccgctggcgagcatgccgccgccgctgaggcagcagggcagccgcaacaaccagctgctgctggaggccgccctgcagatccgtggcgacatcgaccgggccatcgcccgctacggccacagccgcatcggcatcgtcctcggcaccagcacctcgggcatcgacgaagccagccgcggcatcgcccattacctgcgcgaccggcatttcccggccgattacgactaccggcagcaggaactcggcgcgccggcgaattttctcgccgactggctcgacctcagtggcccggcctatgtgatttccactgcctgcacttccagcgcccgcgccctgatgagcgcccgccgcctgctcgacctgggcctgtgcgacgcggtgctgtgcggcggcgtcgacagcctgtgcaagctgaccctcaacggtttctcggccctggaagcggtgtccgcgcagcgctgcaatccgttctcggtcaaccgcgatggcatcaatatcggcgaagccgccgtgctgttcctgatgagcaaggaaaccctcggcgcgcaaccgatcgccttgctcggcggcggcgccagctccgacgcgcaccatatttccgcccccgaacccagtggccgcggcgccctgcaagccatgcagaaggccttgcacaacgccggcctgcacgccgcacagatcggctacctgaacctgcatggcacggccacccagcacaacgacgccatggaaagcctggcggtcgaccagttgttcccggccggcgtgccttgctcgtcgaccaaacccatgagcggccataccctgggcgccgccggggccctggaagcggcgttctgctggctgagcctgtccagcgacaacgccgcgcacgccctgccgccccatgtctgggacgcccaggccgacccgcaactgccgccgctgcattgggtcaccgccaccacacgtctggagcagaacgctccgcgctgcctgatgagcaactcctttgccttcggcggcaacaacgtcagcctgattatcggagacgccccatgattgactggccgctcgccgaactgctgccccacgcgggcgacatgatcctgatcgatcaggtcctggggttcgatgaagagcagatccgcacccgcctcaccgtcaagcccgatggcctgttcaaccgtgccgacggcagcctgccggcctgggtcggcatcgagctgatggcccagagcgtcgccgcctacgccggttgccatgcgcgccagaaaggccaggccgtcgagctggggttcctgctcggcacgcgcaagttcgaatgcaatgtggaacacttccccgccggcagcgaactgcagattcacgccttgcgctctctgcaagacgacaacggcatgggcgtattcgaatgccacctgagtgcccccggcattcaggccgtcgcccgcctcaacgtgttctgtccgccccaggtggacagctacctgaacgaatcacccgctttatcaacaggagtccagccatgactgaatccatattggtcaccggctccagccgtggtatcggccgtgccatcgccctgcgcctggcccaggccggctatgacctgatcctgcattgccgcagtggtcgcggcgaagccgaggccgtgcagaccgaagtcgaggccctgggacgccaggcgcgcatcctgcaattcgatgtgaccgaccgcgccagctgcaaggccgctctcgaagccgacgtggaagcccatggcgcctactacggcgtggtgctcaacgccggcctgacccgcgacggcgcgttcccggccctgagcgaagacgactgggacaccgtgctgcgtaccaacctcgacggtttctataacgtgctgcacccgctgatcatgccgatgatccggcgccgcgcggccgggcgcatcgtctgcatcgcctcggtgtccgggcaggtcggcaaccgtggccaggtcaactacagcgcttccaaggccggcctgatcggcgcggccaaggccctggccatcgagctgggcaaacgcaagatcaccgtcaactgcgtggcgccaggcttgatcgacaccgccatgctcgacgagaacgtgccggtggacgagctgctgaagatgatcccggcccagcgcatgggcaccccggaggaagtcgccggcgcggtgaacttcctgatgtccgccgaggccgcctacatcacccgccaggtgctggcggtcaacggaggcttggtctgatgaaacgtgtggtcgtcaccggcatggccggcatcacttcgctgggcagcgactgggacaccatcgtcgccaacttcggcgccaaccgcagcggcattcgccggatggacgaatgggatcgcttcagcgagctcaatacccgcctggccggccccgtggacgacttcaaggtaccggcgcactggacccgcaagcagctgcgcagcatgggccgggtgtcgcggctcgcggtgggggccgccgagcaagccctggccgatgccggcctgctgggcgacgagtcgatcaaggacgggcgcatgggcgtggcctgtggttcgtccaccggcagcaccgacgagatcaaggcgttcggcaacatgttgctgaactcggtggccgaaggcctcaacgccaactcctacgtgcgcatgatgccgcacaccaccgcggccaatatcagcatcttcttcggcctcaccggccggctgatcccgacgtccagcgcctgcaccagcggcagccagggcatcggctacgcctatgaggcgatcaagttcggccgcctgccgctgatgctcgccggcggcgccgaagagctgtgcccgaccgaagccatggtgttcgacgcgctctacgccactagcttgaaaaacgatgccccgcacaccagcccgcggccctacgacagcgaccgcgacggtttggtgatcggcgagggcggcggcatgctggtgctcgaagaactggagcacgccctggcccgtggcgcgcatatccatgccgagatcgtcggcttcggcagcaacgccgatggccagcacaccacccgtccggagcaggccaccatgcgccgggccatggagctggccctggaagacgccagcctcgagccttcggccatcggttacgtcaacggccacggcaccgctacagaacagggcgacattgccgaaacactggccaccagcagcctgttcggcagccggatgcccatcagttcgcagaagagtttccttggccacaccctgggagcctgtggcgcgctggagtcctggttcagcatcgagatgctcaaccgcgacctctacgtgcacaccctcaacctcgacacggtggacccgcgttgcggcgagctggattacctgcgcggcgaattccggcagatgagctgcgagttcgtgatgaacaacaactttgcctttggcggcgtcaacacttcgctgattttccgccgctggcctcaatgacgttaccccccggagaaaatggaatgtcttccctgcttcgcgcctgcctgatcgtgctggccctgctgacctgtgtctcgtgcaccagcaagcgcatgtacaccccggaccgggtcctgcccgccaccctcaaggccgaccacgaggaaatgaaacaggcgatcctgaaaaacctggtcgcccgcaagtggaccgtgcagcgcatcagcccggagttgatccaggccgagatcaccgtgcgcgagcagtaccacgtggaaatcgacatccagtacacaccgacccactacaagatcctctaccgcgacagccgtggcatgaactacgcggacggcaagatccacaagaactacatccgctgggtgcgcctgctggacaagggcatcctgcgcgagctgaaggacaaccagaacgagcggaccgcgcaacagctgtccagctcggcccaggcgattgccgcgcctaattgagcgccagccgccgcccccctttctatgtcaaggagaccaccatgcaactgaagaccctggccgctgccgccaccctgctgctctgcaccctgcccggcgtcagccaggcccgtgataccgcgctgtacctgccgttcgacaaggtcgtcgccgaagccatcagcaccggcaagatcgacggcagcgtgaagttctacctggccggcaacaagccagccggcaaggtcacggtggtcagcgccggcgcggtcaccaacaagaagaccaatgccttcaacaagagcgacgaagtggcctgcgaatgggtcctgcaatcggcgctgatcaccctgcaccaggcagccaagaacgtcggcgccaatgcagtgaccgacatcgccagcttctacaagagcaacgagcgcaaggacgcgaaaacctacgaatgccacgcgggcgccctgatggcaggcgtcgcgctgcgcggcgatctggcgaaggtggagtaaggcgcctgtcgatgaaatcggcatgacctgatccacagtttccatcccccggaaacgacaaagggcgcctttcggcgccctttcacttacaactcggccttgcgggtcagcagttcgacaaaggccttggccattggcgaacgctggtcggtgcgctgcgccagccacaccgccgagaccgcctcggggtcgagcagcggtcgatagaccacgccgtcgatgcgcatgcgctggtaggacgccggcaacaccgagacacccagccccgccgccaccaggccgatgatggtcatggcctcgcccgcttcctgggcaaagtgcggggtgaagccgacatcccgggccagggtcagcaactgcgcatacaggccgctaccgtagctgcgcgggaagaacacgaagggctcgtgggccagggccgacagcgccaggccggcttcgctgccggccaccagcgggtgcttggagcccagcaccgccaccagcggttcgcgcagcaactccaccacgctcagggaatccggcagcggcaacggccgcatgatcccgacctggatcgactcgtccagcagcgcctcggccacctgggtgctgctcatctcccgcagcttcaggtgcacatcgggaaaacgctggcgaaaggcgaagatcgcctggggaatgcttgagttgaagggcgccgacgaggtgaaaccgatcttcagttcgcccagctccccacgttgcgcccggcgggccacatccgcggccttgtcgacctgggccagcacctgtcgtgcctcatcgaggaacagcctgccagcctcgctgagctcgacccgacgattggtacgctcgaacaaacgagcgccgacctcctgttccagcacctggatctgctggctcaagggcggctgggagatgcccaggacctgggcggcgcggccgaaatgcagctcttcggccaccgcgatgaagtaacgcaggtgacgcaattccatgatcgcctcattaggtcgtgaaacatatcaatcaggtcgaacaatatattggaaagaaacattagccagctatatgcttttttccattgcctgaccggccgcgctccccccgaggtcccccgtgaaaaccgctgtcgctccactcgcccacgaactccctcccaccgccctcgatggggtggtcgcgcaactgaacgaggtctacatcgaaaaaggcactccaatgttcatgcgcacggtgctggcgctgttcagcggcggtttcgccaccttcgccctgctctactgcgtacaaccgatgatgccgctgctgtcccgggaattttccatcaacgccgcgcaaagcagcctgatcctctcggtcgccaccggcctgctggccatcggtctgctggtcaccgggccgatttccgaccgcatcggccgcaagccggtgatggtggccgccctgttcgccgccgcgctgtgcaccattgccagcgccctggtgccgagctggcacggggtgctgctgatgcgcgcgctggtagggctgtccctgagcggcctggcggcggtggcgatgacttacctgagcgaagagatccacccgcagcacatcggcctggccatgggcctgtacatcggtggcaacgccattggcggcatgagcggacgcctgatcaccggggtgctgatcgacttcgtcagctggcacacggcgatgctggtgatcggtggcctggcgctgatcgcggcggcggtgttctggagaatcctccccgaatcgcgcaacttccgcgcccgctcgctgcacccgcgcagcctgctggacggcttcgtcatgcactttcgcgacgccggcctgccgctgttgttcctcgaagccttcgtgctgatgggcgcgttcgtcacgctgttcaactacatcggctatcgcctgctggccgcgccgtatcacatggatcaggccttcgtcggcctgctgtcggtggtgtacctgtcggggatctacagctcggcgaaaatcggcgccctggccgaccgcctggggcggcgcaaaatgctctgggccaccatctcactgatgctcgccggcctcgccctgaccatgctcagcccgttgccggtggtgatcatcggcatgctgatcttcacgttcggcttcttcggcgcccactcggtcgccagcagctggatcggccggcgcgccctcaaggccaaaggccaggcctcatcgctgtacctgttcagctattacgccggttcgagcatcgccgggacggcgggcggggtgttctggcacatggccgggtggaacggcatcggcctgtttatcagcgccctgctggtagtggcactgttggtggcgttgaagctggccaagctgccgccgatggccactcggtagtcgcaaaccaacatgccggcgaccaacccccgcgatccatgtgcgggggccggtcgccggcatgggcgataaccgaggcggtcgatcggcttacctgacgatctccaccaggtcgacgtcgatctcgcgcttcatcaatcccttctcgacctcaccggtcagcctgacctgggtcttctcgttgaacgccactggcggcaggtcttcgtcgtcgatctcgacggtgatggtgccgctggcatccttgaattcgtacttgtcgtcattgttcagcttcttgaccacatggccctgcaacaccaccggcgtatcgtccgcggcatcgttggccgccgcgacgctggtgacggcctgggcgccaggaccggtgtagccgacagccagggcagcagtgctgaacagcggagcgagcaatagaacgaggtaacgggttttcatggcagtgatccaatgtgggtttcgatagcgccagattaaccagtcagactgaattgaaacttaatccgccaggccgtttcccgggcgcaaaaaaaaggcccggcaaatgccgggcctggttatcgggtcgcgatcactggtgatactgcgccgacagttcatgcaccgcgcgcaggaaagcgccggcgtgctccgggtcgacttccggggtgatgccgtggccgaggttgaacacatggccgctgcccttgccgtagctggcgaggatgcgcccgacttcggcacggatcgcctccggcttggcgtagagcacggtcgggtccatgttgccttgcagggcgaccttgctgccgacccgtcggcgcgcttcgccgaggtcgcaggtccagtccaggcccaaggcgtcggcaccggcgtcggcgatgctttccaaccacaggccgccgttcttggtgaacaggatcaccggcaccttgcgcccttcgtgctcgcggatcaggccgctgacgatcttgcgcatgtaggccagggagaactcctggtaagccgccgccgacaggttgccgccccaggtgtcgaagatctgtaccgcttgcgcgccggccttgatctggccgttgaggtagctgacgaccgactgcgccagcttgtccagcagcaggtgcatggcttgcgggttgtcgtagagcatcgccttggtcttgcggaagtctttcgacgagccgccctcgaccatgtaggtggccaaggtccaggggctaccggagaagccgatcaatggcacgcggccgttgagctcgcggcggatggtgctgaccgcgtccatcacgtagcccaggtccttgtgcggatcggggatcggcagggcctcgatatcggccagggtgctgacaaccttcttgaaacgcgggccttcgccggtttcgaagtacaggccctggcccatggcgtcggggatggtcaggatgtcggagaagaggatggccgcatccagttgtggatagcggtccagcggttgcagcgtgacttcgcaggcgaactccgggttcatgcacaggctcatgaagtcaccggcgttggcacggctggcgcggtattcaggcaggtagcgcccagcctgacgcatcatccacaccggggtgacgtctacgggttgcttgagcagggcacgaaggaaacggtcgttcttcagggcagtcatgtcggcatccggaaaaaaagtgcgggcattttctcagagcgcgacgcaaaaggcacggcgagagccgtgccttttatctatcgggtcaatttgtcgcgccacaagtgccgcttctgtagccgctgccgaaggctgcgaacgaccgcaaggcgggcgcaggatcgtgagatcgctgaaggcctgcggccttatcgcagcctgcggcagcggctacagggatggcctttgctgtatcagacgcccaggtagtcgaggatgccttcggcggcgttgcggccctcgaagatcgccgtcaccaccaggtcggaaccgcgcaccatgtcgccaccggcgaagatcttcgggttgctggtctggtgcttgtactggccctgttccggcgccacgacgcggccctggctgtcggtctggatgctgaactgctcgaaccacggcgccgggctcgggcggaaaccgaaggcgatgaccacggcgtcggccgggatgatctcttcggaacccgggatcggctcggggctgcgacggccacgggcgtccggctcgccgagacgggtctcgaccaccttcacgccttcgaccttgtcttcgccgacgatggcgatcggctggcggttgtagaggaacttcacgccttcttccttggcgttcttcacctctttgcgcgagccgggcatgttcgcttcgtcacgacgataggcacaggtcaccgccttggcgccctggcggatcgacgtgcggttgcagtccatcgccgtgtcgccgccaccgaggaccacgaccttcttgcccttcatgtcgacgaagtcttccggcgacttttcaaagcccaggttgcggttgacgttggcgatcaggaagtccagcgcgtcgtgcacgcccggcaggtcctcaccggcaaagccacccttcatgtaggtgtaggtgcccatgcccatgaataccgcatcgtattcttcgagcagttgctccatggtcacgtccttgcccacctcggtgttgaggcggaactcgatgcccatgccgctgaagacttcgcgacgattgctcagcacggtcttttccagcttgaactcggggatgccgaaggtcagcaggccgccgatttccgggttcttgtcgaacaccaccggggtcacgccaccgcgtaccagcacgtcggcacagcccaggcccgccgggcccgcgccgatcaccgcgacccgcttgccggtcggcttgaccttggacatgtccgggcgccagcccatggcgaaggcggtgtcggtgatgtacttctccaccgaaccgatggtcaccgcgccgaagccgtcgttgagggtacaggcaccctcgcacaggcgatcctgcgggcacacccggccgcagacttccggcagggtgttggtctggtgcgacagctcggcggcggcgaggatgttgccctcggccaccagcttgagccagttgggaatgaagttgtgcaccgggcacttccattcgcagtacgggttaccgcaacccaggcagcggtgggcctggtcggccgactgctggggtttgaagggttcgtagatctccacgaactctttcttgcgttgacgcaacagtttcttcttcggatccttgcgcccgacctcgatgaactggaagtcattattcagacgttcagccattgttaaaacctcatcaaactcttcaggcgcatatcactgcgggttggcacgggtgctggaaagcaacgatttcaagctggcagccttcggcttgaccaaccagaagcgacgcaggtagtcatcgaggttctcggccaggttacggccccactcgctaccggtttcctctacgtattcgtccagcacgcgctgcaggtggctgcgataggcttccatcgcttcgccgctgatccgctggatttccaccagctcgtggttgacccggtcaacgaaggtgttgtcctggtcgagcacgtaggcgaaaccgccggtcatgcctgagccgaagttgtaaccggtcttgcccagcacgcagacgaaaccaccggtcatgtattcgcagcagtgatcgccagtgccttccaccacggtgtgggcaccggagttgcgcacggcgaaacgctcgcccgcggtgccggcggcgaacagcttgccgccggtagcgccgtacaggcaggtgttgccgataatcgcgctgtcctgagtcttgtaggcgctgcctttgggcggaacgatcaccagcttgccgccggtcatgcccttgccgacgtagtcgttggcgtcgccttcgaggtacaggttcaggccgccggcgttccacacgccgaagctctgaccggcagtgcccttgaagcggaaggtgatcggcgccttggccatgccctggttgccgtggaccttggcaatttcgccggagatccgcgcaccgatggaacggtcgcagttgcagatgtcgagcgcgaactcggcaccgctgaggtcgttgatcgcaggcttggccatggcgaccattttctcggccagcaggccctggtcgaacggcggattgcgatcgacctggcagaactgcggcttgtccgccgggatatggtcgctgcccagcagcggggtcaggtccaggtgatgctgcttggcggtctggccttcgaggatttccagcagatcggtgcgaccgatcagctcttccaacgaacgcacgcccagcttggccagccactcacgggtttcctcggcgacgtaggtgaagaagttcaccaccatctccacggtaccgatgtagtggtccttgcgcagcttctcattctgagtcgccacgccggtggcgcagttgttcaggtggcagatacgcaggtacttgcaacccagggcaatcatcggcgcggtgccgaagccgaagctttcggcgccgaggatcgccgccttgatcacgtcgaggccggttttcaggccgccgtcggtctgcacccggaccttgccgcgcaggtcgttgccccgcagggtctggtgggtttccgccaggcccagttcccacggcgcaccggcgtacttgatcgaggtcagcggcgaggcgccggtgccaccgtcgtagccggagatggtgatcaggtcggcataggccttggccacgccagcggcgatggtgccgacgccggcttccgccaccagcttcaccgaaaccagcgcctgcgggttgacctgcttcaagtcgaagatcaactgcgacaagtcttcgatggaatagatgtcgtgatgcggcggtggcgaaatcagggtcacgccaggtaccgcgtaacgcagcttggcgatcaggccgttgaccttgccgcccggcagctggccgccttcgccgggcttggcgccctgggccaccttgatctgcagcacttcggcattgaccaggtattccggggtcacgccgaaacggccggtggccacctgcttgatcttcgagctcttgatggtgccgtagcgcgccgggtcttcgccgccctcaccggagttggaacgcgcgcccaggcggttcatcgcttcggccagggcttcgtgggcctccggcgacagcgcgcccagggagatgccggcggagtcgaaacgcttgaggatcgattccagcggctcgacttcgctgatgtccatcggcgtgtccagggtcttcaccttgaacaggtcgcggatcatcgacaccgggcggttgtccaccagcgcggtgtattccttgaacttggcgtagtcgccctgctgcacggcggcttgcagggtgttgaccacgtccgggttgtaggcgtggtattcgccaccatggacgaacttcagcaggccgccttgctggatcggcttgcgcgggctccaggcttcggcagccagggctttctgctcggcttcgatgtcgacgaaacgcgcgcccttgatgcggctcggcacgccacggaagctcaggtcgcagacttcctcggacaggccgatggcctcgaacagctgcgcaccgcggtaggacgcaatggtcgagatacccatcttcgacaggatcttcagcaggcccttggtgatgcccttgcggtagttcttgaacacctcgtagaggtcgcccagcacttcaccggtacgaatcaggtcgcccagcacttcgtaggccaggaacggatagaccgccgaggcgccgaaaccgatcagcaccgcgaaatggtgcggatcgcgcgcggtggcggtttccaccaggatgttggagtcgcagcgcaggcccttctcggtcagccggtggtgcaccgcgccggtggccagggacgcgtggatcggcagtttgcccggggcgatatggcggtcgctgaggacgatctgggtacgaccggcgcgcacggcttcttcggcctggtcggcgatgttgcggatcgccgcttccaggccgaggctttcctcgtagttcaggtcgatgacctgacgctcgaagcccgggcggtcgaggttcatcagcgagcgccacttggcgggcgagatcaccggcgagctgaggatcacgcgggaagcgtgctcaggggattcctggaagatgttgcgctcggcaccgaggcagatctccagcgacatgacgatggcttcgcgcagcgggtcgatcggcgggttggtgacctgggcgaactgctggcggaagtagtcgtaaggcgtgcgcacacgctgggacagcacggccatcggcgtgtcgtcgcccatggagccgaccgcctcatagccttgctcgcccaagggacgcagcacctgatcacgctcctcgaaggtgacctggtacatcttcatgtactgcttgagctggtcgacgtcgtagaacgccgaaccgtggtcgttgtcttccatggtcgcctggatgcgcagggcattcttgcgcagccattgcttgtacggatgacgggacttcaggcggttgtcgatagcgtcggtatcgaggatctgcccggtttcggtgtccacggcgaagatctggcccgggccgacacggcccttggcgatcacgtcttcgggctggtagttccagacaccgatttccgaagccagggtgatgaaaccgttcttggtggtgacccagcgcgccgggcgcaggccgttacggtcgagcaggcagacggcgtagcggccgtcggtcatgaccacgcccgcggggccgtcccacggttccatgtgcatggagttatattcgtagaacgcgcgcaggtcggcgtccatggtctcgacgttctgccacgcaggcggaatgatcatccgcacgccacggaacaggtcgatgccgccggtgaccatcagctccagcatgttgtccatgctcgaggagtcggaacccacgcggttgaccagcgggccgagttcttccagatccatcaggtcgttggtgaacttggtgcgccgggcctgggcccagttgcggttgccggtgatggtgttgatctcgccgttgtgagcgaggaagcggaacggctgcgccagcggccatttcggcagggtgttggtggagaagcgctggtggaacacgcagatcgcggtttgcaggcgcgggtcacccaggtccggatagaaggcggcgaggtccgccggcatcatcaggcctttataaatgatggtcttgtgggaaaagctgcagatgtagtggtcggtatcggcggcgttggctaccgacgaacgacgacgggcactgaacagcttgaccgccatgtcctggtcgctcaggccttcgccgccgatgtagacctgttcgatctgcggcaggcgctccagggccaggcggccgagaacgctggtatcgatcggcactttgcgccagccgatcagttgcaggccttcggccaggatctcgcggttcatgttctcgcgagcggcttcggccttggccggatcctggttgaagaagaccatgcccacggcatattgcttgggcaattcgacactgaaggtttcctgggcaatggctcgcaggaacgcgtcaggcttctgaatcagcagaccgcaaccgtcgccggtcttgccgtccgcgttgatcccaccgcggtgggtcatgcaggtcagggcctcgatggccgtttgcaaaagggtatgactgggttcgccctgcatatgggctatcaggccgaaaccgcagttatccttgaattcatctggttggtacagacctgctttcatagacactttctcaccaggctgcctcttatcgaggcaaatttcttttcaattcaaccagttaccatccacgccgaacgtacgccggctttgcgggggcaaaagggaggtcattgtacacaccgacacagacgctcacaaatttggcgacgaaatgtcgcaaatctatgtcgcatttatgaaaggtttaaagcgatattctgtgctagtcaaaacttttttagttcggaccgcgacgactcaaaagctactgtgacgcagacaccacaaggcacgcggccttgaaggcagcatgcgcatgcggatttttttgaggtgctgggagaggcggcctgggtaaggccgccgaatcttcagcgagttgctgccagttcctgttggacgctggcgacagtgcgaggccaaggtttaccagcctgaaccttcgctggcaaggccttgatagcggtaacggctgcatcacggctgctgaagctgccgtaagtgatcacatacagcggcttgccgttgaggactttcttgaaataacggtactgagcgccttgctccttgacgaagctctgcgccgcggcttcggaactggtgcccaggatctgcacgacgtagttgcctggcgcctgaccggcgtaccagctaccgccggtggcggccttggctacggtgacaggtttctcggctggcttggcgaccggtgcagccggcttgctgaccggagcaggcgcaggcttgaccaccggagccggcttcgcggcagcgacctgggtcggtgccggggtcggacgggcttcaggtgtcggcgccggaccggccggcacgccggctggtggtgcgatagtggtcacggtcggcggcgtggcgctggagccttccaccggcacgccatcgtcaccctcggtgatcccgccggcggcttcggccagaggaccgcgcatcaccggttgcgactggccgaccaatggcagcggcattggctgggaagaaccggcgaactcgacagccgggctgccattgccgttcggttgtggcgtctggcccagcggcagctgcgcctgttcgttggctggcgcaccagcagtacttggtgccttgctgcgacccggcatcagccaggcagcggcaacggccaccactacgactgcggatatcgccaatacgtgtttcttcggcatgttgaaccccatacttggacgcttgaccgctgagcggctggcaatcatggcttcgatcattgcatcccgggcgacctggttgatgttgccaggccagccatcggagccttcgtgaatatcactgatgtgatccgcggagaaaagttcgataccccgccctgcgccttcgagacgctgcgccaggtattcgcgggtttcttcttcggtgtaaggctgcagctcgatgacatggaagcgctcttcttccgcgctcagcagctccaggccggcaatcagcgacgactcgccgaacaggaacacatgcgggcgaccttccggtgcgccggcggcgagcgccagcagtgcctcgagcgccgactcgtcgagctgctcggcgtcatccaccagcagatagacttcctggccggtcagggccagttgcaccacttgcgccaggatcgggccgatttcggcctgctcgacgttcagcgcctgggccacctgccgcagcacgcccgccgcgtcgccggcaccacgggcggaaaccaccacgctctgtaccgactgcttgttggtgctggctaccagggcctgacgcagcagcgtcttgccgctgccttgcgggccggtcacgaccagcagcagttggctgtagcgcgccaggtgatgcagctgccccagcaccggcttgcgctgggcggggaaaaacttgaagccaggcacccgtggagcgaaagggtcatggctcaattgatagtggccgaggaaagcctcgtcggcatgcaaactagtcatggggatcttattaacctttaagctgagccagggcgcggtaatccgctcccagcgtggcctgtaaaacctctttcggataatcgtcggtcactacggcttcgcccatgcggcgcaacagcaccagacgcaaacgaccatcgatcactttcttgtcaattgccatgtgttcgagaaaatccgcttcggtcatttcctcaggcggaatgaccggcaagcctgcgcgctggaacaggcgaatgccacggtcacgctcctcggcggtgatccagccaaggcgtgcggacatctccagtgccattacggtgccagcggcgaccgcttcaccatgcagccagacaccatagcccatgtgggtttcgatggcgtggccgaaggtatgccccaggttcagcgtggcgcgcacgccggactcacgctcgtcggcgcccaccacggccgccttggccgcgcaggagcgttcgatggcataggtcagcgcctgctggtccagggctcgcaagcggtcgacgttgtcttcgagccaggtaaggaacggctcgtcgcagatcagaccgtatttgatgacttccgccaggccggccgacaactcccgaggcggcagggtattgagcgaggcagtgtcgatcagcaccacgttcggctgatagaaggcgccgaccatgttcttgcccagcggatggttgataccggtcttgcccccgaccgacgagtcgacctgggacagcaaggtggtaggaatctggatgaaatcgacgccacgctggtagcaggcggcagcaaagccggccatgtcgccgatcaccccgccgccgagggcgatgatcgtggtgcggcgatcgtggcgcgcggtcagcaggccatcgaaaataagctgcagggtttcccagttcttgaacgcttcgccgtcgggaagaatcaccgagatcaccgagaactgcgcgaggctgcgtttcagacgctcaaggtacagcggcgctacggtttcattggaaacgatcgccacttgtcgcccggcgatgtgcggagccagcaactcgggccggtccaacaaaccttcgccaatatgaatcgggtagctgcgctcgcctagatcgaccttaagtgtctgcatgtgtccccacagtgaagatggaagctggtgtcctgccttgcattaacgactggcatcgcctggctttatgacgccgcgcaatagccatgcgccacaaccgcgagcgatcatggcaaggcgccgaggatagcgcatttcacgctgcgcattaacggggaggcagttgctgcaggcggtccagtatgtccagcaccaccatgcgcggtggccgttcatcggtttcaaccaccaggtcggcgatttcccgataaagcggatcgcgaatcgccaacaagtcccgcagggtcttcgccgggtcggctgtgcgcagcagcggtcgattgcgatcccgtgcggtgcgaccgacctgctgctccaccgaagcatgcagatagaccacacgccccccggcatgcagcgccagacggttggcttcgcgcatcaccgcaccgccgccggtcgccaggaccacaccatcggcggagcacagctcggcgatcatggcctgttcccgatcacgaaagcccggctcaccttctttatcgaagatccacgggatattggcacccgtgcgcaactcaatttccttatcggaatctttgaatggcaggcgcagctctttggccagcaagcgaccaatggtgctttttccagcccccattggcccaacaagaatcaaatttcgcacagaatcaacgactcacagcaatcgcctggttgttcatgatacgcggagtgagaaataccagcagctcggattttttctccgacaccacgtcacgccggaaaaggcggccaagatacggcacatcgccgagaaatggcaccttatctacaaccttgctttgcgtattggagaaaactccaccgatgacgatggtctctccatcgttgatcaggaccttggcgttgacctcgttcttcttgatcggcggcacgtcctggactttgttcaggtagtccggctcgtccttggtgaccttgacctccatgatgatgcggttatccggggtgatctgtggcgtcacctccagggacagcgaggcctccttgaacgacaccgaggtcgccccgctggaggcggcttcctgataggggatttccgtgcccttgaggatcttcgccgtctccttgtcggacgtgacgaccttgggctgggagacgatttccccgttaccggtcttttccatggctgtcagctcaagatccagcaacacattgtcggtgatgaaggcgatacccaggccggaggtattggcggtagtgcccaggtcgacgaacggtgagttgctgctggtactacccggcgtgcctatggtggaggaaccattggcgccgttgctgacccccgaggcattccagttgccctggttctggatcgaaccgccccagcgcacgcccaggcttttgtcgtagtcgacgttggcctcgacgatccgcgcctcgatcatcacctggcgcaccgggatatccagctggctgacgatccgccgcagctcgtccaggcgctcccgggtctggtaggcgatgatgttgttggtccgctcatcgacagtgatcgacccgcgttcgtcggacttgtcctcagcgcgggtgaccgactggaacaacttggcgatctccgcggccttggcgtagttgacctgcagcagttcgcgccgcaatggttccaggtcggcgatctgcttctgcgactccaattcctggcgttcgcgggcagcgatttcatcggccggcgccaccagcaacacgttgcccaccttgcgcttgtccagccccttggtcttgagcaccagatcgagggcctggtcccacggcacattctgcaggcgcaaggtaatgccgccctgcaccgtatcgctggccaccaggttgaggttggtgaagtcggcgatcagttgcagcaccgagcgaacctcgatgtcctggaagttcagcgagagcttttcgccgttgtaggccgagcgctcggcgttgcgtttctgcaggtcgccagaggtcatcggcctgacgctcaccgtgagtttgttatccgtctggtaggtcgagtaatcgaaagtgccgccgggctcgatggtgacgatggccttgccggactccgcccgggcgctgacgaactgcacgggggtggcgaaatccttgacgtccagcctgacccgcaggggctcgggcaggcgggccttggcgaaggtgaggacgagtttgccgtcgcgctcctgtatgtccgggctcatttccgagtcggagaggtcgatcagtacattaccctcgccctgctcgccgcgctggaaatccacgctgcgaatcgaccgacccacggaagccacggccttggcccgccccgacgcgacagccggctgccccggcgcactcagcgccgccgtcgccccctggccgatcaccacaaacagctgattgccagcgacccgagtgctgtagggcgccagcgcgaccagattgacgacaacccgggtacgctgccccgattcgaccaccgtcacactgcgcgcattgccattgcccaggtcacggctcttgtctgccagctggctgacgacaccgggcagatcgagggcgatccgcgccggctggtcggtggtatagccgcgcggctcgggcaccggtccatcgaaggtcagcttcaactccaggcgatcccccggcagtgccgcgacatccagggccttgaggctggccgccatggccatcggtgaaagcaacgccatccatagcgcaataccgaaggctgaaaagatcctgttcatgatgcgagttccactatgagtgttcttttaatggaatggtccgtggtcgctccagccacgctcccgctccatcgggaacaatctcgaccacgtcgacctgtgaatcgctgatcgcgacaatccgcccgtcgttacgccccaggtaatcgccgaccttcagccgatgcacgccaccggcaccacgcaacagcgcaaagaagccggaagcattggaaagggtgcccaccatctcgaactgttcgatgctgaagccctcgagatactgcttgctacggttcggatccggcttgaccgcgggcgagcctgcccgacgtgccgccaggtccaccctgatcgcaggctgaaacgggctgcgcaagggtgcggcgttataggtgaacgttgggtaagacccgaatgccggcattggttcaatctcgccgggcgactgcaagcgcgcctcgttcatgtaggcatccagatcactgaagtcgtcatcgttgccacagccagccagcccgacaaatgccagcaccagcaataagccgtgaacgcgcttcatgagcgtggccccttgtagcggtaagtcctggccagaatgttcatgcgcagcttcgaaccgacctgcggcgtgaccggtttgatctcgaaatcatgcagggtgacgattcgcggcaaaccggccacgccgctgacgaaagtcgccagtgcgtgatagccgccggtaaccctgatctggattggcaattcgacgtaaaacggctggaccacctccggcaacagcttgatctcttcgaactccagcccgctaccaagcccggtgcgactgatgtcttcgagcaagcccggcacctcggtatcgctgggcaactggcgcagcatgaggtcaaaggcggtttccatggccttcatctgttcggtataaggcccgaggttggccaccaggcgcgccttgctggcgaactgctgtttcagcacgacctcgtccgcccggcgctggtcgagttgcagcaacaggtccttgaggtacaggttgtagccgagggccagtaccagcagcatgagcagcgccacgaccacgcctttgaccagcgtcggccacgcccccatgttgctcatttccagctcgccgagatcgatccggcgcatctgcgcccacccgccggacaggttcattgcccttcctcgcccagggcgggccgggtctgatggacggtcagctgaaacacattgacctgatcggcgttgtccgccccggcggccttgacctctgtcaggctcggcgcatcgaaccagtccgaggcgtccaggttgcgcatcaggtccgaaacacgatggttcgattcggccgccccggtgatggaaagagtctgcccgctcatcctgacatcggtgaaatacaccccgtccggcagggtgcggaccaattggtcgaacactcgcgcgctggtggagcgattgccttgcaggtcctggatgatcttcatccgctccaccagttgctcgcgatgcagcttcagctcgccgatcttggcgatccgttgatcgagcaaggtgatttgagcgcctacgtgattgttgcgcgccagttgcctgtcgatcgcccggtcgatgatcctgtcgcccgcgaacaacacacccagggccaccgccgcagccgccgccagggccaggaaaaagtggcgacgccgctgttcgcgccgcgcctcgcgccagggaagaagattgatccgcgccatcagtcgaaactccgcaaggccagcccgcaggcgatcatcaaggacggggcctcgctagccagggccgcggcgtcgaccctggcgccgatgctcatgccaacgaagggattggcgatcagcgcaggcaagcccaggcgctgctcgatcaacgggacaagccccggaaccgaggcgctgccacccgccaacagaatggaatcgacctggtgttgcggggcggaggcctggaaaaactgcaacgagcgcgaaacctgttgcacgaccgcctcctgaaagggttgcagcacctcactggcgtaatcgtccggcaggccaccctgcttttttgcctggccggcctcttctttcgacagcccgtagcggcgctggatgtgttcggtcagttggtgtccgccgaacaactgctcacgtgaatagacgatctgcccttcatgcacgacgctcagggtggtcagggtggcgccgatatcgagcagcgccacggtccgggcagtcggcgagccggccgccagggcgaacgaacgctccagcgcgcagacttccaggtccaccactcgggccgtcagcccggcgagctcgagcgccgcttcgcgaacttcgatgtgctccttgcgacaggccgccaacagcacatcgacgcgttcgggattgcgggccgaatagccgaggacgtcgaaatcgatggcggcctcgtccagcgggtagggaatgtactggtcggcgtcgaccttgagctggctttcccgatcgtcgtcggacagcccggcctccatctcgatgaccttgctgatcaccgccgagccggccatcgccagcgccgcgtgcttcgcacccggccgggccctggccagcaggcgagacagggcatgcccgaccccttcaggctcgacgatgtttttttcgaccacggcgttggccggcaacgactccacgccataggcctcgacccgaaagcggccaccgacacggctcaattcaagaagcttgaccgaggtggagctgatatcgatccccagaagggaactcgcctttttactgaagagtcctagcactaccaattccctatgactatccgtgacttacggactctggaatgtccattgcgttcaatcaccacgtcttgacagacgggcaaatgacgcccttggcggaaaaatgcttataatgcccagcgatttttccgcgatttatctgctgcgtgagccgattcctgactgtgaatacctgacgcccaattcattcctttctctggaaatccaaaagccttgattcgtctgctgaagtttttcgggtggtccatcgtcgctgtgttctgcgggctgctcctcgctctctccggcgcgtttctctatcttagtcctgggttaccgtcggtagaggcgctcagaagtatccagttgcagattcccctgcgggtgtacagcagcgacggcaagttgattgcggaattcggcgaaatgcgccgcactccaatccgtttcgccgacattccccccaacttcattaatgcgttactaagtgctgaagacgacaatttcgccaaccactacggcgtcgatcccagcagcctgatgcgtgccgcgacccagctggtcaagagcgggcacatccaatccggcggcagcaccatcaccatgcaggtggcgaagaacttcttcctaagcagcgaacgcagcttctcgcgcaagaccaccgagatcctcctggccctgcaaatcgagcgccaactgaccaaggacgagatcctcgagctgtacgtcaacaagatctacctgggtaaccgcgcctacggcatcgaggccgcggcccaggtgtattacggcaagtcgattcgcgatgtcagcctggcgcagatggcgatgatcgccggcctgcccaaggcaccgtcgcgcttcaacccgctggccaacccggcgcgcagtaaagagcgtcgcgactggatcctcgggcgcatgtacaagcttggcaagatcagcgaggcggactacaccgcggcgatcaacgagccactgaacgccagctatcacgtgccgacgccggaagtgaacgcaccgtacatcgccgaaatggctcgcgccgagatggtcggtcgttacggcagcgacgcctataccgaaggtttccgcgtcaccaccacggtgccgagcgatctgcaggaactggccaacaccgccgtccatgaaggcctgatcacctacgaccagcgccatggctatcgcggccccgagtcgcgcctgcccggcaagacccacgccgcctgggcccaggaactgaccaagcaacgcagcatcagcggcctggaaccggcgatcgtcacccaggtcgacaagaacggcctgcaggtactgacccgcaccggcgaagagcacgtaggttgggacagcatgaaatgggcgcgcccgttcctgaacaccaacagcatgggcgccgctcccaagcagccgagcgatgtcgcccaggtcggcgacctgattcgcgtgcagcgccaggcagacaactcgctcaagttccgccagatcccggtcgttcagggcgcgctggtgtccctcgatccgcaaaacggcgccattcgctcgctggtgggcggcttcgccttcgagcagagcaactacaaccgggcgctgcaggccaagcgccaacccggttccagcttcaagccgttcgtctatagcgccgcgctggacaatggctacaccgccgccagcctggtgaacgatgcgccgatcgtgttcgtcgacgagtacctggacaaggtctggcgtccgaaaaacgacaccaacaccttcctcggcccgatccgcatgcgcgaggcgctgtacaagtcgcgcaacctggtttcgatccgcctcctgcagagcctgggcgtggaccgcaccatcgactacatcagcaagttcggcttcaacaaacaggacctgccgcgcaacctgtcgctggccctgggcaccgcgaccctgaccccgatggaaatcgccactggctggagcgtgttcgccaacggcggctacaaggtcacgccgtacatcatcgacaagatcgaaagccgcaacggcgaaaccctgttcaccgccaacccgccgagcgtaccggctggcgacacggccagcagcgggatcacggcaccgacgcagcagggcttcacggtggacaacgtccctggcgaaaccccgggccaggcccctgtacaggcacctgcggtggccgaacgcatcatcgatggccgcaccacctacatcctcaacagcatgctggaagacgtgatcaagctcggcaccgggcgacgcgccctggccctgggccgcaccgacctggccggcaagaccgggaccaccaacgaatccaaggacgcctggttctccggctacaacgccgactacgtgaccacggtctggaccggtttcgaccagccggaaagcctgggacgccgcgagtacggcggcaccgtggccctgccgatctggatgaactacatgggcgccgccctcaaggacaagccggcccatacccaggccgaaccggaaggcattctcagcctgcgggtcgatccggtcagcggccgcgccgcgacaccgggcacgccgaacgcctacttcgagctgttcaagagcgaagacaccccgccttcggtcaatgaactgggcaatggctacgctcctggcagcccgctgccggcggacgagtcggcgccgatcgatctgttctgaccgccttcgcgggcagacctctccactggaacgaggcctacccgcgacaaagccgccacggatctccccccgatccaaaacgacacccacaaaaaagccccgactctcgcgagccggggctttttttcaacgcgtcttcggcttagccgttgaacacgtcatccacgcttttgagcgggtagttcttcggatacggcagggtcgccacgccggtctcgatcgcggccttggccacggcatcggagatcacggtgatcagacgggcatccattggtttcggaatgatgtactcacgaccgaattccagcttgataccgccgtaggcgtcgcacacttcctgaggcaccggcagcttggccagttcgcgcagggcattggccgcggccactttcatttcttcgttgatgcgcttggcgcgaacgtccagggcaccacggaagatgaacgggaagcccagcacgttgttgacctggttcgggtagtccgaacggccggtggccatgatcacgtcgttgcgggtggcgtgtgccagttccggggcgatttccggatcagggttcgagcaggcgaacacgatcgggttggcagccatggagctcaggccttcggcgctcagcaggttcgggccggacaggccaacgaacacgtcggcacctttgagggcgtcagccagggtgcgcttgtcggtcgtgtgggcgaagaccgccttgtactggttcaggtcgtcgcgctcggagtggatcacgccggtacggtcgaccatgaagatgttttcgatctgggcgcccatgctcaccagcagcttcatgcaggagatggcggcggcaccggcgcccaggcagacgatcttcgcgtccgacagggttttgccagcgatttccagggcgttgatcatgcccgccgcggtcacgatagcggtgccgtgctggtcatcgtggaataccggaatgtcgcactgctcgatcagggcgcgctcgatctcgaagcactctggcgccttgatgtcttccaggttgatgccaccgaaggtaatggagatgcgcttgacggtgtcgatgaaggcttgcgggctttcggagtcgacttcgatgtcgaatacgtcgatgccggcgaagcgcttgaacagcacgcccttgccttccatcaccggcttggaggccagcgggccgaggttacccaggccgagaatcgcggtgccatcggaaatgactgcaaccaggttgcccttgccggtgtatttgtaggccagctcaggatcgcgggcgatttcgcgtactggttcggctacgccggggctgtaggccagcgacaggtcgcgggcggtagcggtggccttggtgagctcgacactcagtttccctggacggggattggcgtgatattcgagagcggcagttttcaaatcagacatgtgggcattccgcttttttactgttggacagacggaccgccgaggatacgcgtgtcgcaaagtccctacaagactgaccagtcacccctgtcaaggcccgtaggctacgactttgggccaagagccacggaacacaaggggtagactgttcacaatcgaaataaaaaatgtctacaattttttatttattgaaccagctggaacattccgggatgggtcaacggcaacatccagcgcgcctgacccgatttcaaaccacctttgcgtgaacggtcgagcacccagccgcgcgcctcgatctgccgccccggcaggcggtccagctgcacgccatcgaattggccaagcagattgggcgcaatgcgcaatacaaccgaatcctgcaattcgatccagacaccaccccgattgcgttgcaccttgctcacccgaccactgagcagcgcaaatccggaggcctttatctgatccgctttcagtacagacgattgccgccacagccccagccgggcctgccgggcgctacgctcggcggcttgctggcagctgaacaaatcgacgttcggcgcaaccgccacctggtagcccaggccttcggcaagcaattgcgcctcaaggttggcgccatcggcaccatagacatgggccagggtccgcccatagtgatccctgctctcccgaccgggaagcaggccgacccgaccgttgctggccttcaccaacgcctgcagacgctggcgggcggcaaccgcgaagggttcgtcggtgcggccttttttgcccagttccggcgcgttgaggccgatcatgcgcacgctgcggccatcgacgagacgcaaggtgtcgccatcgaccacccgctggacctgcacagaggccagcccgaccggcgccgggcagaacgcctgggcgctggagagccaaatcgcggacacaaaaaaggcgcccgcaagggacgcctttttcatcagcgaggagaagctgaaacagctttccagaccgatcagccttaggcctttttcgcgccgaaagcgccgaaacggtcggcgaacttctgaacgcggccgccggtatccagagtcttctgcttaccggtgtagaacgggtggcattcgttgcaaacgtcgatcgccagcggcttagcgaaggtcgaacgagtttcgaacttgttgccgcagctgcaggttacggcaactgctgggtattctggatggatatcgactttcatggtgtcttcctcaggctagcgtgccgccacccaacactattgttgaataccgcacgtaattaggccgcggattctaccagacctttgcgatcacgcaagctgtcccttgcaccgaccgtctgctaggctccgggccttcttcaccgcccgttcaatgagatttccccgcgtgcccgacgccattttgcgcctcgccctgccctcccccctgcgccgcctgttcgattaccgggcccctgccggcgtactgcgcacccagctgcatccgggcatgcgcctgcgagtgccgttcggtcgccgggaaatgatcggcatcctggtcgaggtcacggacagcagcgaagtcccggccgagaaactcaaaccggcactggccctgctggacgccaccccgccgctgccgcccgcgctgttcaagctgtgcctgtggaccgcgcagtactaccagcacagcctcggcgacaccctgagctgggcgctgccggtcctgctgcgccagggcgagccggccgaggctcggcaggaacgcttctggtcggtcagccccggcgccagtctcgacgacccacgcatcgcccgcgccccacgccaacgcgaagccctggcgaccctggcccaacacccccacggcgtcgcccaccaattgctgagcaagctgatgctgagcaaggacagcctggacctgttgctggccaaggagctggtgcaggtggaagtccgtcggcacgccccgggcgaacgccatgaacattggctggcccagccggaactgccgctcaacagcgaacagcgcgccgcctatgaggccatccgctccggcttcgacagctatcacgccttcctgctggccggggtcaccggcagcggcaagaccgaagtctatctgcagctgatccgcgaaaccctggaagccggcaagcaggcgctggtgctgatcccggaaatcaacctcggcccgcagaccctggcgcgcttcgaacaacgtttcaacgcccgcatcgccctgctgcactcggcggtcaacgaccgcgagcgcctggatgcctggctggcggcccgcgacggcgaggccgacattattatcggcacccgctcggcgctgttcacgccgatgaagaaccccgggctgatcatcatcgatgaagagcacgacggctcctataaacagcaggaaggcctgcgctaccacgcccgcgatctggccctggtccgcgcccgccaggaaaacattcctatcgtgctgggctccgccaccccgtcgatggaaagcctgcacaacgcctacaccggccgttatggcctgttgcggctgaacgagcgggccggcggcgccaagcagccgcgcttcctgcgcctggatgtgaagagccggccgctggacagcggcatttccggccccatgcaacaagccatcggccagaccctggcggcaggccagcaggtgctggtgttcctcaatcgtcgtggttttgcgccgaccctgctgtgccacgactgcggctggatgtccgagtgcgaacgctgcgacgcgcggatgaccgtgcaccagcgctacggcgagctgcgctgccaccactgcggtcactccgagcgcgtgccgcggcattgcccgaaatgcggcaaggtcgacctgcgcccggtcggcgccggcaccgagcgcgccgaagagcggctggcaatcctgttcccggactacccggtgctgcgggtcgatcgcgacagcacctcgcgcaaggacgcgatgaaccagttgttcgccactatccagaagggccagccctgcatcctcgtgggcacccagatgctcgccaaggggcaccacttcccgcgggtgaccctggtctcgatcctcgatgccgacggcggcctgttctccggcgacttccgcgccagcgaacgcatggcgcaactgatcgtccaggtcgccgggcgggccgggcgggccgaagagccgggcaaggtgatcatccagacccacctggccgaccacccgctgctggtgcaactgaccgagcagggttacttcgcctttgccgaacaggccttgagcgaacgccgcgccgccggcctgccgccgttcgcccatctggcgctgctgcgcgccgaggcgcacaagccgggacaggccgaaggcttcctcgacgaagcctgcggcgaggccgagcgtttgctggccgagatgaacctgggcggtatcgaattgctggggccggtgccggcgcccatggagcgccgcgccgggcgttatcgcgcgcaactgctgttacaggccaatgcccgggcgccgctgcacaagctgttgagtcactggctgctggtgctggaacagatgcccagcgggcgccaggtacgctggtcgctggatgttgaccctgtggacctgtattgatagaagaacggccatctcaggcaagcgcacctctgtaggagcgagcgggcggcgatccgacttgcccgcgatatggcccgaatagccaccgcatatccacaagcggcccgctatagttggcaagcccgtcttcgcaacggataatgcccagtttttccacctgcgcatcgaagcgccgccgcgccagcggttgaaagagaagaccatgaaagacaccattcgccagctcatccagcaagccatcacccaactcgtcaccgaaggtgtgttgccagaaggcctgacgccggcgatccaggtagaaaactcccgcgacaagacccacggcgacttcgccagcaacatcgccatgatgctggccaagccggccggcatgaaaccacgcgacctggcggaaaaaatcatcgccgccctgcccgccgacgaacaggtcagcaaggccgagatcgccggccccggcttcatcaacttcttccagaacacccaggccctggccacccgcctgggtgccgccctcgccgacgcccacctcggcgtgcgcaaggccggcgcgttgcaacgcaccgtggtcgacctgtcggcaccgaacctggccaaagagatgcacgtcggccacctgcgctcgaccatcattggcgacggcgtggcgcgggtcctggagttcctcggcgataccgtgatccgccagaaccacgtgggcgactggggcactcagttcggcatgctgatggcctacctgcaggaaaacccgatcaccagcgacgagctgtcggacctggagaacttctaccgcgccgccaagcagcgcttcgacgaatccgaagagttcgccgaccgtgcccgcggcctggtggtcaagctgcaggccggtgacgcggactgcctggagctgtggaccaagttcaaggacatctccctgtcccactgccagaagatctacgaactgctgaacgtcaaactgaccatggccgacgtgatgggcgaaagcgcctacaacgacgacctgatcaacgtggtcaacgacctcaaggccaagggcatgctggtcgagagcaacggcgcccagtgcgtgttcctcgacgagttcaagaacgccgaaggcgagccgctgccggtgatcatcgtcaaggccgacggcggctacctgtacgccaccaccgacctggcggccgtgcgctaccgcagcggcaagctcaaggccgaccgcgcgctgtacttcgtcgaccagcgccaggccctgcacttccagcaagtgttcgcggtggcccgcaaggccggcttcgtgacccacccgatggacatggagcacatgggcttcggcaccatgaacggcgccgacggccgtccgttcaagacccgcgacggcggcaccgtgaagctgatcgacctgctgaccgaagccgaagagcgcgcctacagcctggtcaaggaaaagaacccggagctggccgaggccgatctgcgcaacatcgccaaggtggtgggcatcgactcggtgaaatacgccgacctgtccaagcaccgcaccagcgactacagcttcaacttcgacctgatgctgaacttcgaaggcaacaccgcgccttacctgctgtacgcctacacccgcgccgccggtgtgttccgcaagctgggcaaggacttcagcgaagtacagggccagatcaccctcgaagccgcccatgagctggagctggcggccaagctggcgcagttcggcgaagtgctgaacaacgtggccgacaagggtacgccgcacatcctgtgcacttacctgtacgacgtggccgggctgttctccagcttctacgagaactgcccgatcctcagtgccgaatcgccgacgcagatgcagagccgcttgcgcctcaccgagctgacccgtcgtaccctcaagcaaggtctggaattgctgggcctgaaagttctggagcaaatgtaagttggctgccaagaaaaaacctgcacccaagcgtggcgccagccgttaccaagctcctgcgaagcaaccgatcccgggttggttgtggatggccatcggcctggccgtgggtgccttcatcgtgttcctgatgaagctggagccgggcaagggcggtgacagcgtcaagcgcgagcggctggagcaacagaaaaccaccaagatcgccgaggccaataagaccccgccgagcccgcagcaaccggtgaagccgaagtacgacttctacaccctgctgccggaatcggaggtgatagtgccgccggaagccgtgccggaaaaaaccctgccgacgccgcagactgcgccagtggttccgaccaccccggtgactccggcggaagcggcgaagatcgacaccgcgcgcgcgcaggccgccctggccggcatcaccccgccgcccgcaccaccggtggcacaggcacaggtggcgaaggccgcgccggtgaccaggttcttcctgcaggccggttcgttccgcaagcagaccgatgccgacaaggtccgcgcgcagatcatcctgttggggcaatcggtgtccgtcgagtccggcaccgtcaaggacgagacctggtaccgcgtactggtgggcccgttcagcaaccgcgaacagctcaccaccgcgcagaagcaactgtccggcgccggcttcagcaacctgctgttacaacagcgccagagccgctaaagcggctgatcgcgagcaagctcgctcctacaaggcctgcgccaaacctgtaggagcgagcttgctcgcgatgacgtcctcattgacaccgcctcccccagcagcaaagaccgctcgtcccacaacccccagcgcagttgaaaaaccccgcgtcacccccatatgagttcccatcagggcattttcgccccgcagcgtggagactctccccttgaccaccatcgtttcagtccgccgccacggcaaagtcgtcatgggcggcgacggccaggtttccctcggcaacaccgtgatgaaaggcaacgcgaaaaaggttcgtcgcctgtatcacggccaggttatcgccggctttgccggggccacggctgacgccttcaccctgttcgaacgtttcgaaggccagcttgagaaacatcaggggcacctggtacgcgccgccgtcgaactggccaaggaatggcgcaccgaccgctccctcagccgcctcgaagccatgctcgccgtcgccaacaaggacgcttccttgatcatcaccggcaacggtgacgtggtcgagccggaggacggcctgatcgccatgggctccggcggcgcctatgcccaggccgcggccagcgccctgctgaagaaaaccgacctgtcggcccgcgaaatcgtcgaaaccgccttgggcatcgccggcgacatctgcgtattcaccaaccacacccagaccattgaggagcaggatctcgcggaataagcctgtttcggccatcgcgccacggcattcattcttgcttgaggaccgccaattactatgcccatgactccccgcgaaatcgtccacgaactcaaccgccatatcatcggccaggacgatgccaagcgcgccgtcgccattgcgctgcgtaaccgctggcgccgcatgcagctgcctgaggagctgcgtgtcgaagtgaccccgaagaacatcctgatgatcggcccgaccggcgtcggcaagaccgaaattgcccggcgcctggccaagctggccaacgctccgttcatcaaggtcgaagcgaccaagttcaccgaagtcggttatgtcggtcgtgacgttgagtccatcatccgcgacctggccgatgccgcgatcaaactgttccgcgaacaggaaatgacccgcgtgcgccaccgtgccgaagacgccgccgaagaacgcatcctcgatgccctgctgccaccggcgcgcatgggtttcagcaacgaggacgccgccccggcccaggactccaacacccgccagctgttccgcaagcgcctgcgcgaaggccaactggacgacaaggaaatcgagatcgaagtggctgaagtcagcggcgtcgacatttccgcgccaccgggcatggaagagatgaccaaccagctgcagagcctcttcgccaacatgggcaagggccagcgcaagaaccgcaagctcaagatcaaggacgcgctcaagctgatccgcgacgaagaagccagccgcctggtcaacgatgaagaactcaaggccaaggccctggaagcggtcgaacagcacggcatcgtgttcatcgacgaaatcgacaaggttgccaagcgtggcaactccggcggcgtcgacgtctctcgcgaaggtgtccagcgtgacctgctgccgctgatcgaaggctgcaccgtcaacaccaagctgggcatggtcaagaccgaccacatcctgttcatcgcttccggcgcgttccacttgagcaagccgagcgacctggtgcccgagctgcaaggccgcctgccgatccgcgtcgaactcaaggcgctgtcgccggaagacttcgagcgcattctcagcgagcctcacgcctccctgaccgagcaataccgcgaactgctgaaaaccgaaggcctggtcatcgagttccaggcggacggtatcaagcgcctggcggagatcgcctggcaggtcaacgagaagaccgagaacatcggtgcccgtcgcctgcacaccctgctcgagcgcttgctcgaagaggtgtcgttcagcgccggcgacctggccagcgcccacaacgaagagccgatccgcatcgacgccgcctacgtcaacagccacctgggcgaattggcgcagaacgaagacctgtcccgctatatcctctgagcggcaagccatgagctgcaagctgcaagtgatcgcggtcatcttgtagcttgcggcttgcagctttaagctgcccccatgaccagactgcccaccgccatcaacctgcacaaagcctcgaagaccctgacgctgacctatgcgccagacgaggtctatcacctgcccgccgaattcctgcgggtgcactccccctccgccgaggtccagggccacggcaaacccatcctgcaatttggcaagatcggcgtcggcctgaccaaggtcgaaccggcgggccagtacgcactgaaattgaccttcgacgacgggcatgacagcggcctgttcacctgggactacctgtaccagttggcggtgcgccaggacgatctgtggaaggattatcttgccgaacttcaagccgccggaaagtcccgcgacccgaatgagtctatcgtcaagctgatgctctagatcagacctctgacgctttagagggcattttctagattcatctgtttgaatgttgggctgcatggccaacgattggcctgcttgcgaaaaaaattaaactcgggtaaccaatggagctggcaagttccctgcagtgttctctgaacaaaaaagtagtaatgcagaatcaacggtcacccgagcagtggtacctggcatctttgctgtgtgactacacagcaggtccggtactcgtctcaggacaatggagcgtcgtagatgagtaacaagaataacgatgacctgaaacgccaagcctcggaaaacactctgggcctgaatcctgtcatcggtttacgtcggaaagatctgcttacctctgctcgtatggtgctgacccaggccatcagacaaccgctgcacagcgccaaacatgtggcccacttcggcgtcgaattgaagaacgtgatgttcggcaaatcgacgctgcaaccggagagcgatgaccgtcgcttcagcgatccggcctggagccagaacccgctgtacaagcgttatctgcaaacctacctggcgtggcgcaaggagcttcacgactggatcggccacagcaacctctccgaacaggacatcagccgcgcccacttcgtcatcaacctgatgaccgaagccatggcgccgaccaacaccgccgccaaccccgcggcggtcaaacgcttcttcgagaccggcggcaaaagcctgctcgatggcctctcccatctggccaaggacctggtgcacaacggcggcatgccgagccaggtcaacatggacgccttcgagatcggcaagaacctgggcaccagcgaaggcgcggtggtgtttcgcaacgacgtgctggaactgatccagtaccgcccggtgaccgagcaagtgcacgagcgcccgctgctggtggtcccgccacagatcaacaagttctatgtcttcgacctcagcccggacaagagcctggcgcgcttctgcctgcgcaacggcgtgcagacctttatcgtcagttggcgcaacccgaccaaggcgcagcgcgagtggggcctgtcgacctacatcgaagcgctgaaagaagcggtcgacgtggtcaccgccatcaccggcagcaaggacgtgaacatgcttggcgcctgctccggtggcatcacctgcaccgcgctgctggggcactacgcggccctgggcgagaagaaggtcaatgccctgaccctgctggtcagcgtgctcgataccaccctcgacacccaggtggcgctgttcgtcgacgagcagaccctggaagccgccaagcgtcattcctatcaggctggcgtgctggaaggccgcgacatggccaaggtcttcgcctggatgcggcccaatgacctgatctggaactactgggtgaacaactacctgctgggtaacgagccgccggtgttcgacatcctgttctggaacaacgacaccacccggttgcccgcggccttccacggcgacctgatcgaaatgttcaaaaacaatccactgatccgccccaacgcactggaagtgtgcggtacgccgatcgacctgaaacaggtcaccgccgacatcttctctctggccggcaccaacgatcacatcaccccatggaagtcctgctacaagtcggcccaactgttcggcggcaaggtcgaattcgtcctctccagcagcgggcatatccagagcatcctcaacccgccgggcaaccccaagtcgcgctacatgaccagcgaagagatgccgcccagtgccgacgactggcaggaaaactcgaccaagcacactgactcctggtggctgcactggcaggcctggcaggcggagcgttcgggcaaactgaaaaagacgccgagcattctcggcaacaaggcgtatccagcggccgaggcggcgccgggtacttatgtccatgaacgttaaccgatagcaagcctgtaggatcgagccgcttgcgctgatgctgctgcgcaagcgactctctcctgcaggcaacgattccaccaacagggccaaggcatgcctcaaccgttcatctttcgcaccgtcgacctggatggccagaccatccgcaccgcggtacgcccaggcaagcctcacttgacacccttgctgatcttcaatggtatcggcgccaacctggagctggtgtttccattcgtccaggctctggacccggacctggaagtcatcgccttcgacgtaccgggcgttggtggttcgtcgacgccgagcctaccctaccgctttcccagcctggccaagttgactacacgcatgctcgattacctcgactatgggcaggtcaatgtggtgggtgtgtcctggggcggggcgctagcccagcagttcgcctacgactaccccgaacgctgcaagaaactggtgctggccgctaccgccgcgggcgccttcatggtgccgggcaaacccaaggtgctgtggatgatggccagcccacggcgctacatccagccctcccatgtgatccgcatcgcccccctgatctacggcggctcgttccgccgtgatcccaacctcgccgccgaacatgccagcaaggtccgctcggcgggcaagctgggctactactggcaattgttcgccggcctcggctggaccagcatccactggctgcacaagatccatcagccgaccctggtgctggccggcgacgacgacccgctgatcccactgatcaacatgcgcatgctggcgtggcgaattcccaacgcccagctacacatcatcgacgacgggcatctgttcctgattacccgggccgaggccgtggcgccgatcatcatgaaattcctcgaggaggaacgacaacgggcagtgatgcacccgcatccgacgccgttcagcggtgcgtagcaaaaagcgtctgccgacaggatcgtcgcgcgcgcaggatggttcaggaccgactatggtgtttgtcttggtgtgcttgttgatggcttgacgaaggagtgttgaagcatgcgagacaaaccaacggcgggctcgttgcccacgcccgccacctacatcactgcccagagtgccatcaccggcctgcgtggccgtgacttgttgtcgactctgcgcagcgtggccacctacggcctgcgtaacccggtgcacagcgcgcgtcatgccttggcgctaggtggccaattgggccgtgtactgctgggcgaaacactgcacaaacccaatccccaggacaaccggttctccgatccgacctggagcctgaacccgttttatcgacgcggcctgcaggcctatctgagctggcagaaacagatcaaaagctggatcgacgacagcggcatgagcgcggacgaccgggcccgcgcgcactttgccttcaacttgctcaacgatgcggtggcaccgtccaacaccctgctcaatccgctggcgatcaaggaaatcttcaactccggcggcaacagcgtgatccgcggcatcagtcatctggtcgacgatctgctgcataacaacggcctgcccagccaggtcaccaaacaggccttcgaggtcggcaggagcctggccaccactcccggttcggtggtgtttcgcaacgagctgctggaactgatccagtacaagccgatgagcgaaaaacagtacgcccggcccctgctggtagtgccgccgcagatcaacaagttctatatcttcgacctcagccccaccaacagcttcgtgcagttcgccctgaaaaacggcctgcagaccttcatgatcagttggcgcaaccccgatgtccggcatcgcgaatggggcctgtcgagctatgtcgaggccgtggaggaagccatgaatgcctgccgggcgatcaccggcagtcgtgacgtgaacctgatgggtgcctgtgccggcggcctgaccattgccgccctgcaaggccacctgcaagccaagcgacaactgcgtcgggtcgccagctccacctacctggtcagcctgctggatagccagctggacagcccggcgaccctgttcgccgacgaacagaccctggaggcagccaagcgccgctcctatcaacgcggcgtgcttgacggtcgtgacatggccaaggtgttcgcctggatgcggcccaacgacctgatctggaattactgggtcaacaactacttgctgggcaaggagccgcccgcgttcgacatcctctactggaacaacgacaacacccggctgccggctgcctttcatggcgatctgctggatttcttcaagcacaacccgatgagtcatcccgggggcctggaagtgtgcggcacgccaatcgacctgcaaaaggtcacggtcgacagcttcagcgtcgccggcatcaacgaccacatcaccccctgggatgcggtgtatcgctcaaccctgctgctgggcggcgacaagcgcttcgtgctgtccaacagcgggcatgtgcagagcatcctcaacccgccgagcaaccccaaggccaactacgtcgaaaacggcaagctcagcagcgacccgcgggcctggtactacgacgccaagcacgtcgacggcagttggtggacgcaatggctggagtggatccagcagcgttccggcgcccagcgcgaaaccctgatgaccctgggcaaccagaactacccaccgatggaggcggcgcctggcacctacgtgcgcgtccgctgaatttccccgcgccgcggcccgagggtcgcggcctgactgaacaaccaagaagactggatgaaaacccgcgaccggatactcgaatgcgccctgcagctgttcaatcacaagggcgaacccaatgtctcgaccatggaagttgccaacgaaatggggatcagccccggcaacctctactaccactttcacggcaaggagccgctggtcctcgggttgttcgagcgctttcagaatgagctggcgcccctgctcgatccgcccgccgatgtgcacctggctcccgaagactactggctgttcctgcacctgatcgtcgagcgcctggcgcactaccgcttcctgttccaggacctgtccaacctggccggacgcctgccgaagctggccaagggaattcgcaacctgctcaacgccctgaagcgcaccctggcctcgctgctggccaggctcaaggcttcgggccaactggtcagcgatacccaggcgctggggcaactggtggaacagatcaccatgaccctgctgttctcgctggactatcagcgcattctcgatcgcgagggcgaggtacgggtggtggtctaccagatcatgatgctggtggcgccgcacctgttgccaccggcgaaactggccaccgagcagatggccctgcgctacctcgacgagcacgattgagcggcgccgcaagagccccacgaacaaaaacgcccgacctttgcaggccgggcgttttgtatgccccgaaaaactcaggactgactggttggcgtcgcgggtgctggcgcggcagtcggggtgacagcaggggttggcgccactgcggaattcgcagggctgaccggtgctgcgggcttggcggcaaccgcaggcttcggtgcagcggccttgggtgctgccggtttcttcactgctggttttttcgctgccggtttcgcggcgggcttggccgctggttttgccgctggcttggcggcaggttttgcagccggcttggccgccgcagttttggctgccggtttcgcggcaggcttggctgctgccttggccggagccttggctgccggcttggccgctgctttagccagaggcttggccgccggtttggccgctgcagtcttggccgcgatcggagccactttggcgcctgtgagtttttcgatctgtttggtcagggtgtcgaccttgctgtgcagcgccttgacttcattgcggctaggcacgcccagacgcgaaatggcactgttcaagcgcttgtcgaatgcaccttccagctcgtcccacttgcccagcgcgcggtccttgacgccactgatgcgcgattttgccgagctcgcggagtccttggcggcgtcgactttcttgccgacagcgcttttggtgagcttctcggctttctcgccatccttgaccagcgactcgaaaagcttgctgccgtcagtgtcgattttcgagtacacgcctaaaccagcaagccagattttacgggagtagtcttcgaccttcccgatccacgagctgccttctttttcagtattctttttaccagccatcccgttctccttaatgtttacgcgcgacacgttcgagcaatgccgtcagctcatcgagcttagcagagagtgtctcaacgtcatgtttagacggaatgccgatgcgattcaaggcacttgcgacgcgcgtgtcaaaagccctctcgactttatccagctgcacttcgactttgcctctgagactggtgacatcccccttcacgctatcaatctgactgttggcggcctcaagttgttcagtcacaacttttttgcctttcttttcaatagtttgaccagccttaacgagctcttgaaagtactcgctgccttcctggccaaccttggtgtaggcacccaggcctgccagccagatcttgcgggcataggatttgacttcactcagagtggttgatgcggcatcaacttttttcttcagaattactttggccatagtgcacctcacgcgcagaaggtttgaggaactgcccgcaggaaagtgggctcaggcacaaagtagtgagaaaaattagaatcggcaccctaaccaatgtcataaaagagtggacgattattggagaaaccagctcgccagcgacgctttcccaggcgtcatgacaacacccgaaatcgccggcaagccgacttccgcgaaagcgcctcagaccagggctttatccagcgccttttcgatttccgacttgatcatgccgctcatggcggacatcaacaggcccagctcaacatcgaccctgatcgaatcgtcgcccacctgcaccgcacctttgacccctgaacgcttgaggttcagggtatcgcccgaccactgcggctccaggccatactgatcagccagtttctgcgccaactggtcagccttttcgcgggctgcctccttacccaggccgtgggcacgctcaacacttatacgggccattgaatgactcctgatttatcgggacttgccttgagcgtcttgagctgcgctgcgtcaaaacgccccggcgcttcactatcttacattcagccttgccaagacaaagaccgccaccgggattagaatgtcccgcattctcttttggtgacagcgatatgactgatcagcgcaaaggcagcgatgccgaacccaccactcacttcggcttcaaaaacgttccggaaagccagaaggcggaaaaagtcgctgaggtgttccactcggtagccgccaagtacgacctgatgaacgacgtactgtccggtggcatgcatcgcctgtggaaacgcttcacgatcgaattgtccggcgttcgccccggcaatcgcgtgctggacatcgccggcggcaccggtgacctgacccgcaagttttcccatctggtgggccctaccggccaggtggtgctggccgacatcaacgcttccatgctcaaggtcggtcgcgaccgcctgctcgacaagggcgtggccggcaacatcgagttcgttcaggccgacgcggagaaactgccgttcccggacaaccatttcgacgtcgtgaccatcgccttcggcctgcgcaacgtgacccacaaggaagatgccctgcgctcgatgctgcgggtactcaagcccggtggccgcctgctggtgctggaattctccaagccgaccaacgccctgatgtccaaggtctacgacgcctactcgttcgccttcatgccactggccggcaagctgatcaccaacgactcggaaagctatcgctacctggccgaatcgatccgcatgcaccccaaccaggaaaccctgaagtcgatgatgatcgaggccggtttcgatcgcgtgacctaccacaacatgaccgcgggcattgtcgccctgcaccgcggcatcaaaccctgatgttgttcagcggcctgctcgccagcgtcgaacacggcctcaaccgtgtactgcgtctcgacagcacggctttgccacgcttgcagcctttgaacggcaaggtcatcgccgtcgattgccgcagcccgagcgtgcagttgttcgtcattcccggcgacgagggcctgaccctcgccgcgcattgggccgccgacgccgactgcaccctgcgggcgccggcctcgagcctggtgcgcctggccctgagccaggacaagaccgcggtgctgcacggccccgaggtcgagctggaaggcgacagcggcgtgctgctggaactggcggccgtcctccaggacctggagctggactgggaatacgaactctcgcgctggctcggcccggtggccacccagctgttcagcggccatatccgtagccgcgcgcgctggtaccgccagggtttcgccagcctgaaccagaaccttgccgaatacctggccgaagagtcgcgcaccctagtgggccagcgcgaagccgaagcccgtttcagtgaactggaccgggtcaagctcgacctggaacgtctcgaggcgcgcttcgagcgcctttcccgatcccttgacccaagcgataacgcatgaagctgcttgccgtccgccgtttgttgcgcatccagcgcgtcgtgatccgctaccgcctcgatgacctgctgttcgccctgccgctgccctggttcctcctggcgctgcgctacgccttgccctggcgctggttcccgcgcaagccactggaactgagccgcggcgcacgcctgcgcctggccttgcaggacctgggaccgatcttcatcaagttcgggcagattctctcgacccgccgcgacctgctgcccgaagacatcgccgacgagctgatgctgctgcaggaccgcgtaccgcccttcgactcgaagaagtcggtggcgctgatcgaggagcaactgggcaagaaaatcagcgaggtgttcagccgcttcgatatcgaacctctggcctccgcctcggtggcgcaagtccatgcagcccagctcaagagcggcgaagaagtggtggtcaaggtcatccgcccgggcctcaagccggtcatcgcgcaggatctggcctggctgttcatcctcgcccgcgccgccgagaaggtctcggccgacgcccgcctgctgcacccggtggacgtggtcagcgactacgaaaagaccatctacgacgaactcgacctgttgcgcgaagcggccaacgccagccagctcaagcgtaacttcgaaggctcgccactgctctacgtgccgcaggtctactgggactggtgccggccgaaagtgctggtcatggaacgcatctacgggatccaggtgaccgacctggccaccctcgccgaccagcgcaccgacatgaaaatgctcgccgagcgcggcgtggagatattcttcacccaggtgttccgcgacagtttcttccacgccgacatgcacccgggcaacatcttcgtcagcaccgtgcagccctggagcccgcagtacattgccatcgactgcggcatcgtcggcagcctgactccggaagaccaggactacctggcccgcaacctgttcgcgttcttcaagcgcgattaccggcgcgtggcgcagttgcacatcgattcgggctgggtgccggcagagaccaaactcaacgaattcgaagcggcgatccgtaccgtgtgcgagccgatcttcgaaaaaccgttaaaggatatttccttcggccaggtgctgatgcgcctgttccagaccgctcgccgcttcaacatggaagtgcagccgcagctggtgctgctgcaaaagaccctgttgaacatcgaaggcctgggccgccagctgtacccggagctggacctgtggaacaccgcccagccgttcctcgaacgctggatgcgcgagcgcgtcagcccgaaagccttgctgggcaacctgcacagccaggtcgaacaactgccgcacctggccaacatgacccgcgacctgctcgagcgcatgtcccagccccatgcccaggacccgtctcccccctggaaacggcgcaaggacgactggttcctgcgtcttctcggcgcggcgcacctgggtggtggggcgatcctcgcggccggcggaccgctgaacgggctgggtcactggccggctggaatcatgattgccgtgggcttgtatctggtcgtgcgccgatagccagccgggctagcggctggcacactgtttcccatcgccgaggctcgacgagcgcgtcgagccctgttgtcggagtcgaagatgaaagattggctggacgagatcaaatgggacgctgacggcctggtgccagccatcgcccaggatcacaagaccgggcgcgtgctgatgatggcctggatgaaccgcgaggcgctgagcctgaccgctgccgaaaaccgtgccatctactggtcacgttcgcgtggcaagctatggcgcaagggagaagagtccgggcatgtgcaaaagctccatgaaatgcgcctggactgcgatgccgacgtcatcatcctgatggtcgaacagattggcgacattgcctgccatacaggccgccagagctgcttctaccgcgtttatgaaaacggcgactggaaaacggtcgatccggtactcaaagacccgcacgcgatctatcaagcaggacactgaacatgagcgataccctgacccgtctggcccaggtgctggaagagcgcaaaggcgccgccgccgacacttcctatgtcgccagcctgtaccacaagggcctgaacaagattctggaaaaagtcggcgaggaatcggtggaaaccatcatcgccgccaaggacgccgcccacagcggcgactgcagcgatgtgatctacgaaaccgccgacctgtggttccacactatggtcatgctcgcccagctggggcagcatccgcaggccgttctcgatgaactggaccggcgcttcggtttgtccggacacgccgagaaagcctcgcgtccgtccgcctgaacatcatttagagaggaaacgcagcatgggcatttttgactggaaacactggatcgtcatcctggttgtcgtggtgctggtgttcggcaccaagaaactgaaaaacctcggcaccgacgtcggcgaatcgatcaagggctttcgcaaggccatgaacgacgacgaaaaacccgccgaacccggcgtgccaccgaccgcccagcctgctccgccggtccagccgcaaagcgctccgttgaaccagccgcacaccatcgacgtgcaggcgcaaaaagtcgaagagccgacccgcaaagactcgtgagcactgactaatgtttggtatcagcttctctgaactgctgctcgtcggcctggtggccctgctggtgctcggccccgagcgtctgccgggcgccgcgcgcacggcaggcctgtggatcggccgcttgaagcgcagcttcaatgcgatcaagcaggaagttgaacgggaaatcggtgccgatgaaattcgtcggcaactgcacaacgaacacattctgtcgctggaacaggaagcgcggaagatcctcaatccgacccagcaacagccgacaccggtcgagcccgtggccgagcagagcattcatgcgcccgccgcggcgcctgaagcgccagccagcgcgaccacggcgagccccactgccgcaactgcaccggccgaaccggctgcgcccgtgacaacacctgtcacgccagccccccacgaccctactttgccgccgcgagccccatgagcgatattccggaaaacgaccaacatatgccgctggtgtcgcacctcaccgagttgcgcacccggttgctgcgctgcgtggcggcgatcttcctgatcttcggcgggttgttcgccttcacccagcagatctacaccatcgtctccacgccgctgcgccagtacctgccggcgggcgcaacgatgatcgccaccgacgtggcgtcgccgttcctgaccccgctcaagctgacgatgatggtctcgctgtttctggcgatcccggtgatcctgcaccagatctggggtttcatcgctcccggcctgtacaagcacgaaaagcgcatcgccgtaccgctgctggtctccagcatcctgttgttctacatcggcatggccttcgcctacttcctggtgttcccgctgatcttcaagttcttcgccgcggccaccccggccggcgtggaaatgatgaccgacatcaccagctacctcgacttcgtcatgaccctgttcttcgccttcggcgtggcgttcgagatcccggtggcggtggtgctgctggtgtggatcggcgtggtcaacgtcgcctacctgaagaagatccgcccgtacgtgatcatcggctgcttcgtggtcggcatgatcctgaccccgccggacattttctcccagaccttgctggcggtaccgatgtggctgctgttcgagatcggcatcctgttcggcagcctgatcagcaagcgcggcgaccatccggacgaccagccggctgaagatcacaacgaccagccgccagcgacccaagcgtgaacctgctgcttcttgaagaggccgacttcatcgcggccgaccgggtgatcctgcgcgatcgccgcctgacccacatgcaggaagtccatcgggccgcggtgggcgacagcctgcgggtcggccgtatcggcggcctgatgggctcggccgaactgctgcgcctggagcccggggaagccgaactgcgagtcagcctcgaccagccaccgccgaccaagctgcccctgaccctggtgctggccctgccccgtccgaaaatgctccgccgggtgctgcaaaccgtcgccgccatgggtgtgccccggctagtgctggtgaacagctaccgagtcgagaaaagcttctggcaaaccccgttcctcgaacccgaggcgattcgcgagcaactgattcttggcctggaacaggcccgcgacagcgtgctgccggaagtggtcatcgaaaagcgcttcaaacctttcgtcgaagaccgtctgccagcgctggtcgaaggcaccctcggcctggtcggccatcccggccaatacccggcctgccctcgcggcctggatgagccagtgaccctggccatcggcccggaaggcggctggatcccttacgaaatcgacctgctgggcaagtccggcctgcaaccggtgcagctcggcgagcgcatcctgcgggtcgaaaccgccgtcactgccctgctcgcccgcctcttctgattagcccccactcccgtaggagtgaggctggcccgcgatagcgatgtgcctgacacggcgccatcgcgggcaagcctcgctctgcttcagatttatctgatcaagccgatagcctgggtacaaaacctattaatcgcccaagggagttcgcggcatgtaccgttggttagcccagagtctgggaaatgtgagcgtcaacctcaaactcggcgttggcttcggcctggtgctgctactgaccctgctgatcaccgcgaccggctggctgggcctgggcaatgtgatcgagcgcggcgacaagctgggctacatctccaccctcaacgagctgaccaaggacctgcgcatcgcgcgcctggactatgaaatgcgccgtggcgagcaggggccgggggccgtcagcgagctgctgaacaaactcgacgaaggcttgcaacgcgcacgcaagatgctggaaatgcctgaaagcatcgccatgatcgaccaacagatcgccgccgtcagcgagtacaagctggccttcgccgacatgacccgcgccaccgccagccgtgaagccgcccgcgccaaactgggcgccaccgccgataacgccgtggcccgggtggccgaagtggagaaatccatgctgcagggcgacagcgtggcgcagttcaatagcgtcatcgacctgagcaagctgatccagcaggcgcgtttccaggtccgcggctacacctacagcggcaaggccgaggccgaacagccggcgctggacgccatcgacaatgccctgaacaacctcgccagcctgccggccaagctgccggaacagcacctggccaacctgcaacaggccaccgacgccctgaaaggttatcgctcggcggtcagcgacttccgcgactcccaggtggccagcgccgccgccctcaaacgcatggcggcccagggcgaccgcctgatggacgtcagcaagcaactgaccgccgcgcaaactcacaaacgcgacagcgacgccgcccaggccagaagcaccctggccatcgtcaccgcgctggccctgctgttcggcctggtcgccgcctggagcatcacccggcagatcgtcatcccgctgcgccagaccctcaaggtggtcgagcgtgtcgcttcgggcgatctcagcgagaacctgcaggtcgagcggcgcgacgagctcggccagctgcaacgggccatgcaacgcatgaccctgagcctgcgcgagctgatcggcggcatcagcgatggcgtcacccagattgccagcgccgccgagcagctgtcagcggtgaccgaacagaccagcgccggggtcaacagccagaaagtcgagaccgaccaggtcgccaccgccatgaatgaaatggccgccacggtccaggaagtcgcgcgcaacgccgaagaagcctcggaagcggcggtcgccgccgatcagcaggcccgcgaaggcgacaaggtggtcggcgaggccatcgcgcagatcgagcgcctggccgccgaggttggcaattccaccgcggccatgggccacttgaagcaggaaagcgacaagatcggcagcgtgctcgacgtgatcaagtcggtcgcccagcagaccaacctgctggccctcaacgccgctatcgaagccgcccgcgcgggcgaagccggtcgcggtttcgccgtggtcgccgacgaggtacgcagcctggcgcagcgcacccagaagtccaccgaagagatcgaggagctgatcgtcggcctgcagaacggcacccaggaagtggccaacatcatggacaacagccgcagcctgaccgacagcagcgtcgaattgacccgccgcgccggcggctcgctggaaaacatcacccgcaccgtctcggcgatccaggcgatgaaccagcagattgccgccgcggccgaacagcagagcgcggtggccgaggaaatcaacagaagcgtgctgaacgtgcgcgacgtgtccgagcagacctcggcagccagtgaagagacagcggcctccagcgtcgagctggcgcgcctggggacccatctgcagaccctggtcgggcgcttccgggtctgagccagggcgacggcgatccctgtagccgctgccgagcccgcgaggctgcgatcgccccgcaggggcgcagcgatctcaaggccgtcagatgttcggcctgagatcgggaaccaaggtcctgcggaccttatcgcagccttcggcagcggctacagggcgtattgccaagcagggtatcggggtgggttacaggacctgacgcaaaaacgcctgggcccgcgggtcttggggcgcatcgaagaacgccgctggcgaggcgtcttccagcagtttgccgtgatcgaaaaacagcacccggtccgccacttcccgggcgaagcccatttcgtgggtcacgcagaccatggtcatgccttccagggccagggtcttcatcacgtccagcacttcgccgaccatttccgggtccagcgccgaagtcggctcgtcgaacagcatgaccttaggttccatggccagcgcccgggcgatggccacgcgctgctgctggccgccggagaggcgcgaggggaattcgttggccttctgcgcgataccaaccttctccagcaacgccagggccttggcctcgcgctcctgcttgccgcgcttgcgcaccaccttctgcgccaggcagaggttttccagcacggtcatgtgcgggaacaggttgaagtgctggaacaccatgccgacttcgcggcgataggcattcacatcggtcttcggatcggccagttgcaggccgtcgatgctcaccgaaccggaatcgaactgctccaggccgttgaggcaacgcaggaaggtcgacttgccggaaccggacggaccaatcaccaccagcacttcgcccttggccacgtgggtggtgacgttatccaccgcgcggaccacctggccccgggtgtcgaagacttttaccagatcgcgaacttcaatcactttgcgcgagcctccgctcaagccggctggccatcttcgacagcggcaggttgatcaacaggtacagggccgccacgcagaacaggatctcgaacggcgagaacgaggtggtgatgacttctcgtccgctcttgagcagctcggtgatggcgatcaccgacaccagcgaggtgtccttcaccaggctgatgaactgcccggccagcggcggcagcacacgcttgaaggcctgtggcaataccacatggcgcatcgactggctggcgttcaggcccagggaacgggccgcctcattctggccacgggcgatcgactgcacgccggcgcggacgatttccgccacataggcaccggtgaacagcgacagcgcggcgatcccggcgaattcgcgggacaggttcagcaccgtgccgatgaagaaatagaaaatgaagatctgcaccagcagcggcgtaccgcgcaccagttcgacgtaaatggtcgacaggtcgcgcagggtcgggttgttcgacagccggcaaagcccggtcgccaggccgatgaacaagcccagcaccccggacaccaccgacagccacaaggtggtccacaggcccagcagcagcggtccggccgcccagtgacgggtcacgccgatcacatcgccttcggccacatcgtcgccacgggcgacttgcaggctgttctcgtcgaccgtcagctgttgctcgtcgcccgcgtcgttgcgcagcgtgacttcggccttgccgcctttgcgcaccagctcgctgacggtggagatgtccgccgcccgctgcgattcctcggcctggtaggcgaagtactgtggtacgcggttccagcgccactcgtaggacatcagcgaggtggcgtagtacaacgcgccggccaggccgatcagcaccagcacggtcagtacgtgccagggccattgggcttttttatgtttgatcactttgcaggttccagctcggggaagttcggtggtgccgatcaggacgccatcgcgagcaagctcgctcctacagggggtatgcggttcctgtaggagcgagcttgctcgcgatcaaccgcgcagcggttgtagatttactccatgtccttgagccactcagtgctcttgaaccacttgtcatggatacgatcgtaggtgccgtcttcgtggatctggtgcaggaagttgttgatgaagttgaggctgtcgtagtcacccttcttcaggccgaacgccagaggctcgtaggtgaacggcttgtcgaggaacgtaagcttgccgttgccgaccttgctcagcgccaccacgttgtacggggcgtcgtagatgaaggcgtcggccttgccgttgaccacgtcgagcacggcttcctgctcgttgtcgtagccgtggtacttggccttggcgatcagcttcctggcgaccatttcgccggtggtgcccagcttggaggtgatgcggtaatcggcgctgttcaggtctttataggacttgatggtgccttccagctccttgcggatcagcagggtctggccgaccacgatgaagggctcgctgaagttcagacgcaggttgcgttcctgggtcagggtcatgccgctgccgatcatgtcgaacttgtcggtcagcagggccgggatgatcccgtcgtagccggtggaaaccagctccagcttgacgcccatggccttggtcatggccttgaggatgtcgacctcgaaaccgatgatctcaccgcgcttgttggtcatctcgaacggcatgtaggtcgggtccatgccgactttcagcgtgccgcgcttgaccgcatcatcgatggcgccagcctgggctgcattgaccgccaccattgccgtgacgccgagcagcagcatcgagagatacttcttcatcttcaagtcccctgaacccattttattgtgaggtgaacccgcggcaggttttcccttggaaaaccggcagatacggacaccatgggcccgctcgcggcaattcggggtgcgatgctaactcacccgcctatttgcacaagggcttgaccaggatttgttgttacagaggggacgacaatctccctgtagccgctgccgcaggctgcgataggtccgtaggacctcctgcgatcccacgatcctgcgtccccttcggtacggaatgccacccaatcgatcgcagcctgcggcagcggctacaagagcgggcccacaaacaacaacgcccttgagagtgctctcaagggcgttgtcatcaggccggttgggcgattgccgttggcggtcgcaacggcaacaacggtgcatgaggatcctcatccaccgattgccgccaggcgctcagccagtcggcgtggccttcgctccagacctgctcgtgcaggcgggccagggccaccggatcgctcaacagcgccaggcgctcgccgttgttcagcgccgccggcccgactttcagggcatggcggacacgttcgatacgcagccactcgatcggctcggcctggccgtgccgggacgtcgccagggcacaggccagggcgttctgctgcggatcgaccactgcccggatgaaaccatcgttcagcgcatgccaacggttttcatgggtgtactggtcggtggacagcagttcctgaggcggtgcgtattcttcggggatcaggaacaggctttcgtcacgggacttcaggcccaggccgacgcggctggaaatcaccgacaccgggatcgacagcatcagcgaaccgacgatcggcaccaaccaccagaggaagctcgggttcagccagatcaccagcagcgcccagcagaagcccagcagggtctgcggaccatggcggagcaccgcttcgctccacggcgtggaatcgtcgtcacgctgtggcgagttccaggtcgcggcccagcccaggaacgcggccagcacgaaacgggtgtggaagatcatgcgtaccggtgccagcagcatggagaacagcatctccagcagcatcgacagggtcaccttgaacttgccgccgaactctttcgcgcccttggcccagatcaggatgatgctcaacagcttcggcaggaacagcagcacgatagtggtcgagaacagcgcgatcgccttgtccggatgccattgcggccacagcggatacagctggcgcggctccaggaagtactgcggctccatcagcgtgttgaccgccagcagcgccgtcgacagcaccaggaagaagaaccacaacggcgccgacaggtaggacatcaccccggtgaggaacaccgcacggtgcaccgggtgcatgcccttgaccaggaacaggcggaagttcatcaggttgccgtggcaccagcgccggtcgcgcttgagctcgtccagcaggttcggcggcagctcttcatagctgcccggcagatcataggcaatccacacgccccagccggcgcgacgcatcagcgctgcttcgacgaagtcgtgggacaggatcgcaccggcgaaggcacctttaccgggcaacggcgccagggcgcagtgctcgatgaacggcttcatgcggatgatcgcgttgtggccccagtagtgggattcgcccagctgccagaagtgcaggccggcggtgaacagcgggccgtagacgcgggtggcgaactgctgcatgcgcgcatacagggtgtccatgcccgaggctttcggcgcggtctggataatacccgcgtccggtgtggcctccatcaggcgcaccaggctggtcaggcattcgccgctcatcacgctgtcggcgtcgagcaccaccatgtacttgtagtcgccaccccaacggcggcagaagtcgtcgaggttaccgctcttgcgcttcacccgacggcggcgacggcgatagaagatcttgccgaaacccttggtttcgcggcagacgtccagccaggcctgttgctcggccacgcagatatcggtctcgttactgtcgctgagcacgaagaagtcgaaacggtccaggtcgccagtggccgcgaccgactcgaaggtcgcccgcaggccggcgaatacccgcggcacgtcttcgttgcagatcggcatgaccagcgcggtacgggcatccttggggatcggctcgttgccggcgcttttgccggaaatgcggtatttgtcatgcccggtgagcagttcgaggaagcccatcagcgcggtccagaaaccggccgagacccagcagaacaggatgccgaacatgatcaggatgctggtctgcagggcatacggcagtacctgggtggcggtctgcatcaatggctgacgcgtgatttcttccaggtcgacgaacgaccagccctggtacggcatgatgcctttcatgtaccagccggcgacgatggtctggccaagcatcagcagcaacaggatgtagcgacggatcgaaccgacggtacgccagcgggcggccggcagcacgttctgatctttcggtggctgcggcggattagtccgaccggtcaggcgccgccagccacgcaccaggatattggtgcgccatggctcgggaacgaccttggtccgacgaatcggcggcgtggccttgaggcacacacgaccgctggcgtcgagcgccagcatctcggcatcgatcagttcctcggcggaacccagggtcagccggcggcccaccgaggcctgggcggcatcggcgggcgcgtcgaacgtcgacgacgacaggcgttcgtgcagttcactaaaggacttgcagcccgcgagttccgcgcgctgctcatcggtcattggcaggtgcgccagatactcggcaagagtctctggctgtacttgagcgttactcatcggcaggcaactggtagctccaggtctcggtcaggacttgctcggtcgggacagattccggtgtggctggggccgcctcggcagcagcaggctgcttggcgtctttgtggttcttggcgtccttggccggcttggcttcggcttgcttggcatccgcctctttcttctcctgctgcttggcggcgactttgtcggccttggcaatggaggcgctggaggctggcgacacggccttggccggctcgacaggggtggcgttcttgaccagggccgcgcgcatctcggtggatttgctcgggtccttgatcttcatccgcagggtcaggcgccagcccttggtttcagggttgtagcgcacgctgttttccaccagctcggcgttgtcgccgacgctgacctggctgcgcacctcggtgtcttccggcaatgccgccagggatggaccttcgaagtccaccaggtaagccacactgccgtccggttggcggatcaggttggattgcttgacgtcaccggtggagcgcagggtctgctcgacccaggagctgtccggcgaatgcagggaggcttcgtccatggtccagtgcaggcgataggcgaaatcgaatggctggcctggctcaggctgcttttccgggctccagaacgccacgatgttgtcgttggtttcgtccgcggtcgggatctctaccaggtcgacggtgcctttgccccagtcgcccttcggctcgatccaggcacttgggcgcttgtcgtagcggtcgtcgaggtcttcgtagtggctgaagtcgcggccacgctgcagcagaccgaaaccacgcgggttttccaccgagaagttgctcacggccaggtgtttcgggttgttcagcggacgccagatccactcgccgttgccggcatggatcgacaggccgctggagtcgtgcagctcgcgacggtagttgaggactttcgacggctggttggcgccgaacaggaacatgctggtcagcggggcgatgcccagcttgccgaccttgtcacgcaggaacattttggccttgacgtcgacgatggtgtcgctgcctggacgcagggtcaggcgataggcgccggtggcgcgcggcgagtccagcagggcgaagatcaccaggtgcttgtcggtcggcttgggttgctggatccagaattcggtaaagcgcgggaattcctcaccggacggcagcgcggtgtcgatggccaagccacgggccgacaggccatagacgtgccccttgccgacgacgcggaagtagctcgcgccgagcatggtcatgatttcgtcctgcttgtccgccttgttgatcgggtacagcacgcgaaagcccgcataaccgagctgctcggtggccttgggatcgaacttgaggtcgccgaagtcgaagcgagtcgagtcgtatttgatctcttcgacggtgttcgccgtgatttcgttgattttcaccggcgtgtcgaaatgcatgccctgatgatagaaggacagcttgaatggggttttctgcttggcccactcggccttttcaggcaggaagcggattttctgatagtccgcgaacttcatctcacgaaattcgttcggcaggttactgcgcggagcctcgtacttctgcccggccagatccttagccttggccgatacatcatccagattgaatgcccagagttggccggcgctaagcaggcaaagcagtgcagagcccgtcaccagtgcgtttcgtaaccgtttggcagacaattttggtgcattacagggactaacaatcacgagcaaccctcgccgaaaacagatcaaaaaaccaacggccagctatctatatgccaggttggcgagcattgttccgactccgatggggctaaatgattccccaaacggtcccgaacaagtctctacctaagtcaaaaacggaccaacgaacgctgatccccgtagcgcgcgattatctagtagcccgcgttacaacgcatcaggggcgaccaagtatttatcgcgaaaaacgcctattttcggccggttccggccgaaaaagatgtttcaagcactttcaggtctgtaacaggaaggttaccgggccatcattgaccagatggacctgcatatccgccccgaagcgccctgatgctactttgccatgcaactgttgcgccttgcataacagataatcaaaaagttcttcaccgagggccggcggcgccgccgtggaaaaactcgggcgcaggccgttcttggtgtccgcggccagggtgaactgcgagaccagcagcaaaccgccgtccacatcggccagggacaggttcatcttgccctcggcatcactgaatacccgatagttaagcagcttgtgcagcagtttgtcggcactggcccgagtgtcctcgggctccaccgccaccagcaccagcaaaccctggtccaccgccccgacgatttcccccgccacttcgacccgcgcgccgcgcacgcgctgcaacagccccttcatgcttcttcgggcggcaggtcgagcaggcgccgggccatctgatcagcggcacgcaccagcgcatcggtgatgcccggttcggacgcagcgtgaccggcatcgcggatcacctgcagctcgctgttcggccaggcctgatgcaattcccaggcattgtccagcgggcagatcacgtcgtagcgaccatgcacgatcacgcccggcaagtgggcgatcttgcccatgtcgcgaatcagctggttcggctcgaggaacgcatggttggtgaagtagtggcattcgatccgagcgatcgacagcgcgcgctgcggctcggagaaacgatcgaccaccagcgggttcggccgcagggtcgcggtccgcccttcccaggtcgaccaggccttggccgcatgcatctgggcgatctggtcgttaccgacgagacgcttgtggaaggcgctgagcaggtcgtcgcgctcgtccagcgggataggcgccacgtagtcctgccagtaatcggggaacagacggctggcgccggcctggtagaaccattcgatttcctgcggacggcacagaaagatcccacgcagaatcagaccatgaacacgctcaggatgggtttgcgcataagccagggccagggtcgaaccccaggagccgccaaacaccacccatttttcgatgcccaggtgcaggcggatccgctcgaggtcggcgaccaggtcccaggtggtgttgttttccaggctggcgtgcggggtggagcgcccgcaaccgcgctggtcgaaggtgatgatgcggtacaggttcggatcgaagtaacggcgactctgggcatcgcacccggctcccgggccaccgtggatgaacaccaccggcaaaccttccggggatccgctctcatcgacatacagtacatggggttcgtcgacagccagatcgtgccgggcatagggtttgatctgcgggtacaaagtctgcattgcgcgctccgtaaggggtcgaggtcatccctggggggacttcaattattctgccgtccggcatcataaacccgaattacgcaatgagcatgtccttggagacattagggttgtttgcgcgttttgcgttgtcgtcgaagggcttgccgcggacagactcgctcctgtagccgctgccgcaggctgcgatcgctcccgaagggagcgcaaggtctgaaggacgtcgaaggccttcggccttatcgcagcctgcggcagcggctacagggcttcctgtcgacttcagcgcccgtaacgcttctgcccccaggccagcagcccttgcagcagctgcttgagcaccacctgggtcggcgccgccagatcgtcgcggtagcggaacggctcgaactcttccatgtaggtgctctgcgccagctccagctgcacggcatggatgttctcggccgggttgccgtagtgccgggtgatatggccgcccttgaaacgaccgttgagcacatggctgtagtcggcatggcgggcgcagatcgcttccagctggctggccagttcggcatcgcagctggcgccattgaaggtgcccaggttgaagtccggcagcttgccttcgaacagatgcgggatcagcgagcggatcgagtgtgcatcgaacagcaaggcatagccgaactcggccttcaaccgcgccagctcctgctgcaaagtgccgtgataaggcgtccagacctgctccaggtaagtcgcccgctcctgcttcgacggctccagcccctcacggaacagcggcacgccatcgaacagcgtggccgggtacaacccggtggtggcgccgacatatagaggcttgtcgtcggatggacgattgaggtcgatgacgaaacgcgaatactcggccgccagggtgctggcgcccagttcctcggcgaacgcgtagagccggggaatgtgccagtcggtatccggcaggctttgcgcctcggggatcagcccggcctcgaccgcgggcgtcaggcgcagaccggcgtggggcatgctgatcagcagcggcacccggccttgtttgaagttcagaaccttatccacaacccttctcctataaatccacttcaacgccgtggcgcacgacgcgtttttccaggtcgccgcccagccagtaggccaggtcggcgggacgatcgatctgccaggcgacgaagtccgccaccttgccggcctccagcgaaccgtgggtctgttccatgcccagcgcggtggccgcatgcagggtcacgccggccagggcttcttccggggtcatgcggaaacaggtgcaggccatgttcagcatcaggcgcagggacagcgccggcgaagtgccggggttgaggtcgctggccacggcgatcttcaccccgtgcttgcgcagcgcctccatcggtggcaactgggtttcgcgcaggaaatagaacgcgcccggcaacagcacggcgacggtgccggcctcggccatggcgacggcgtcctcctcggtcatgaactccaggtggtcggccgacagcgcgtgataacgcgccgccaggctggagccatgcaacgacgacagctgctcggcgtgcagtttcaccggcaggccaagcttgtgcgcggcgatgaacacccgctccacctgctccggcgagaacgccaggtattcgcagaacgcatccaccgcgtccaccaggccctcggccgccagggccgggagcatttcgttgcagatgtgctcgatatagtcgtccgcacgctcggcgtattccggcggcaaggcgtgggccgccaggcaggtgctgcgcacactgaccggcagctcggcgcccaggcgccggatcacccgcaggatcttgcgttcgctggccaggtccaggccgtagccggacttgacctcgacgctggtcacgccgtcgcgcagcaggcttttcaagcgcttgcgggcgctgtcgaacagttcgtcctcgctcgccgcgcgggtagcccgcacggtgctggcgataccgccaccggcggcggcgatctcggcgtagctcaccccttgcaggcgttgctcgaattcgccgctgcggttgccgccgaataccgtgtgagtgtggcagtcgatcaggcctggggtgacccaggcccccgccaggtcatgcagctcggcatagttaccagccgggacctggtcgcgcgggccgatccactctatgagcgctcctgacgtcacgatggcggcatcctcgatgatcgagtaagcaccttgcgccatgcttgcgacgtgacagtgttgccagagagttttcatccgaggactccgttaattatcgatgggacaaagaagggtcgcggtgcacctggaccgcctgaccggcagccggcttgacccacaacagataagcgatcaccagcagcacgatccacactgcccccaccgccagcgcggcctgggtttgcgggaaataacccagcacaccgaagacgaacagcatgaacacgatggcggctgccggcgcccagggccagaacggcaccgggaatttcagttgggcaacctgctcggcgctcatcgagcgacgcatggccacctgggtgaccaggatcatcagccagacccagaccgtggcgaaagtagcgatcgaggcaatcagcaggaacacgttttccggaatcaggtagttcagcagcacaccgcccagcagcgcggcgcccatgaccaccacggtcatccacggcacgccgtgtttcgacagttgggcaaagcctttgggcgcctgcccttgctgggccaggccgtacatcatgcgtccggcgccgaagatgtcgctgttgatcgccgacaccgccgccgagatcaccacgatattgaggatggtcgccgccgagccgatgcccaggttgtcgaagatctgcacgaacgggctgccctggctgccgatctgcggccatggatagatggccatcagcacgaacagggtcagcacatagaacagcaggatgcgcatcggtaccgcgttgatcgccttggggatgacccgctgcgggtccttggcttcaccggcggtgataccgatgatctcgatgccgccaaaagcgaacatcaccaccgcgaacgaagcgatcaggccgccgatgccgtggggcatgaagccgccgtgggcccagaggttggccaccccggtggcctgctcgctgctggccgaaccgataccgaacaacatgatgccgaagccggcgaggatcatcgcgacaatcgcgccgactttcagcagcgacagccagaactccatttcgccgaagaccttgacgttgcacaggttgaggccgccgatcaggaacacgatgccgagcacccagacccagcgcgccacttccggaaaccagaagcccatatagatgccaaaagccgtgacgtcggccaggcagacgatgatcatttcaaaggcgtaggtccaaccgaggataaagcccggcagtggtcccaggtaattgctggcgtagtgaccgaacgagccggacaccgggttgtgcacggccatctcgcccagcgcgcgcatcaccatgaacaccgcggcgccaccgatcaggtaggccaggaggaccgcgggaccggccatctggatggccgaggcggaaccatagaacagcccggtgccgatcgccgaccccagcgccatgaagcgaatatgtcgggcggacagcccgcgtttcaatccttgagcttgctgttgcatttctcgttcctaattatttttatcggagaaaaccggaaccacctgtagccgctgccgaggcacgaggctgcgatgggctgcgcagcagcccccgacggcggtcctgcggaccgcttcgcagcttcgtacctcagcagcggctacgggcatggggttacaggctcggcagcaacttggccggcagcagctcgttcaggcaacgggatgccagcagttcgctcgcggcattgatgtccggggcgaagaagcggtccttctcgtagaacggcactttgctacgcagggtggcacgggctttttccagcttggtcgaggtcttcaggccgtcacgcaggtccaggccctggcaggccgccagccattccacggcgaggatgccacgggtgttttcggccatttcccacaggcgcttgccagcagcgggcgccatggacacgtggtcttcctggttggcggaagtcggcaggctgtccaccgagtgcggatgggccagcgccttgttttcgctggccagggccgcggcggtcacctgggcgatcatgaagccggagttgaccccaccattggccaccaggaacggcggcagctgggacatgtgcttgtccatcatcagcgagatgcggcgttcgctcagggaaccgatttcggcgatggccagggccatgttgtcggcggccatggccaccggctccgcgtggaagttgccgccggagatcacatcgccctcggcggcgaacaccagcgggttatccgacacggcgttggcttcgaccaccagcacctcggcggcctggcggaactgggtcaggcaggcgcccatgacctgtggctggcagcgcagggagtacgggtcctgcaccttgtcgcagttctggtgcgacttggagacttcgctgctgtcgcccagcaagtcgcggtaagccgcggcggcgtcgatctggcctttctggccacgggcggcatgaatccgcgcatcgaacggcgaacgcgagcccagcaccgcctcgacggtcaggccgccgcaggccagggcgccggcgaacaggtcttcgccttcgaacaggccgcgcagggcaaacgcggtggaaacctgggtgccgttgagcagcgccaggccttccttggccgccagggtcagcggcttgagaccggccacgctcagggcttcggtggcgtccagccattggcctttataacgggccttgccttcacccagcagcaccagggacatgtgcgccagcggcgcgaggtcgccggaagcgcccaccgaacccttgagcgggatatgcgggtagacctcggcgttgaccagggcgatcagcgcgtcgatcacctggcggcggataccggagaaaccacggctcaggctgttgaccttgagcaccatgaccaggcgcaccagggcgtcgctgatcggctcgccgacaccggcggcatgggacagcaccagggagcgctggaggttttccaggtcttcgctggcgatacgggtcgacgccagcagaccgaaaccggtgttgatgccgtaggcggtgcggttctcggcgaggatctgctcgacacaggcgacgctggcgtcgatctgtgccgaggcgctgttatcgaggctgagggttaccggctgttggtagacggcacgcaattgggccagggtcagttggccgggaatcagatttagcgcagtcacattcatgctccttttgagagtttgttattaactaccagtcgctccggaagcttccgttgtccgtcgcagcccgccgtttgtgagcgagtggcgccttggcacgctggtttttcgtggaaaccgttgtcttggaaaatcctgtacttgcagggcgcgcttagcgcacgcccggtaaaacctcctgcagcaaggccggagccttgagcagcgccgccgcgctggcgatgtccggggccagccagcggtcctggtcataggccggaacccgctggcgcagcagcttccaggccgcgtcggtgccggcaccgaaacgctgctccttgagaaattcgaaggcctgggccgccagcaggtattcgatggcgaggatctgggtgcagttttccagcgcgcgggaaagcttcagcgcggcgttggtgcccaggctcaggtggtcttcctgcaggccggaggtgacgtagttgtcgagcaccgccggttgcgccagctggcggttttccgcgcacagcgaggcagcgacgtactgcacgatcatcatcccggagttgaccccggggttgctcaccaggaacgccggcaaaccgctgacatgggggttgatcaggcggtccaggcggcgctcggcgatcgagccgatctcggccatggcgatcgccagcaggtccgccgccagtgccaccgactggccgtgggggttggcctgggacatcacccggtagttgtccggagtgcccagcaccatcgggttatcggtgaccgagttgagttcggtttcgacctgctgcgtcgcgtgcgccaactgatcgcgggcggcgccgtgaacctgcgggatggaacggatgctcagggcatcctgggtgcggatgcctttgctggcggcaatcacttcgctgccgtcgagcaaggcgcgcaggttgatgccgacctgctgcatgcccgggtgcggcttgagcgcaatgatctcggcatcgaacgcggcgatctgcccgcgctgggcctcgaagctcatggcgccgatcacgtcggcccattgcagcaggcgcgtggcatcggccagggccaggcagctcaggccggtcatgcacggcgtaccgttgaccaggcacagaccgtccttggcccccagttgcaccggcttcaggccttccgccgccagcgcctgctcggccgacacgacctgcccgcgatagctgacctggccgacaccgagcaaggcgatgctgatatgggccatgtgggtcaggtaacccaccgaaccctgggacggtacttgcggagtaataccgcgattgagcagggccagcagcgcctcgaccacccggcgatgcaggccggacttgccgtggctgtagttgacgacagccgcgcagatgatcgcccgggtctgctcgtcggccagcggcacgcccacgccacaggcatggctgagcagggtgttgcgcgacagttggctgagctgttcgtcctgcagcgaaacgttgcacagcgcgccaaggccggtgttgatgccataggcgcgttcgccgctgacgacgatgcgctggacgatggcctgggcattctcgatgcgcgcccaggcctgggccgacagctcaagctgtgcgccatgccgggccacggcgaccacatcctgccaacgcaacggggcgtcggcgataacgattttttcagcctgcgacatgccaggaccctcgaatactttattgggaccgcttcgcggtctatcgcgagcaagctcgctcctacaggctgtgaaaaatctgtaggagcgagcttgctcgcgataaaaacctacagcccacccactcccaagcctttaaaccaccgccgcgcgtcgctgcacgaaacggtcgacatactcgtccgccggcgaatgcaggatctctttcggcgtgccgacctggatcagccggccatccttgaggatcgcgatgcggttgccgatgcgcacggcctcgtcgaggtcgtgggtaatgaagacgatggtcttgtgcagggtcttttgcagctccagcaattggtcctgcatctcggcgcggatcagcgggtcgagggcgctgaaggcctcgtccatcaggatgatgtcggtgtccgccgccagggcgcgggccaggccgacgcgctggcgcatgccgccggacagctggtgcgggtacttgttctcgtagcccttgaggcccacggtgttgatccagtgcagcgcgcgctcggtgcagacttccttgctctcgccccgcaccttgaggccgtaggcggtgttttccagcacggtcttgtgcggcagcaggccgaagctctggaacaccatgctgatcttgtgccggcgaaattcgcgcagggcttccatgtcgtattgcaggatgtccacgccatccaccaggatcgcgccgctggtcgggtcgatcaggcggttgaagtggcgtaccaacgtcgacttgccggagccggacaggcccatgatcacgaagatctcgccggtgccgatgctcagcgacaggtcgttgaccccgaccacgcaaccggtctcggccagcacctggtccttggtcttgttctggcgaatcatgttcagcgcgtcggccgaacggttgccgaaaatcttgaaaacgttcttgacttcgatcttgctcacgattgcgtcgttcatttgctcacctcatggcgtggacgaccataggcttgggtaatacggtcgatgaccacggccagaatcacgatcgccaggccggcttccaggccacggccgacgttgagggtctggatgcccaccagcacgtcttcgcccaggccacgggcaccgatcatcgaggcgatcaccaccatcgacagggccatcatggtggtctggttgatcccggccatgatgctcggcagggccagcggcagttgcacgccgaacagttgctgccagcggttggcgccgaaggcgttgatcgcctccatgacttcgccgtcgacctggcgaatgcccaggtcggtcaggcggatcagcggcggcgcggcgtagatcacggtggcgaagatcgccggcaccttgcccaggccgaacagcatcagcaccgggatcaggtacacgaagctcggcatggtctgcatgatgtccaagagcggcatcagcaccgaacgcaggcgattgctgcgcgccgagaggatccccaggggaatgccgatcagcaccgaaatgaaggtcgccaccagcatcagtgccagggtctgcatcagcttgtcccacaggccgaccgcgcccaccaggaacagcaggccgacgatcaccgcggtggtcaccagcttgcgggtcgaatgccaggcgatgccgccgacgatcgccagcatcagccaccagggcgccaggcgcagcaggccttcgaggttgacgatggcccacagcagggtgtcggagatgtggcggaacacatcgccgtagttggtgaccagcgaatcgacccaactgttgacccagtcggcgatggaaaaggtgaagctttcaggaaacatagagagactctcgatcaagtgggttgcggcaaggctcccggctgcgcttcaggcagccgggaaggctctacctacaaggccgcgtcgattttcttggctgcgtcgtcgctcacccatgcgtgccagacttcaggatgttccttgaggaaaattttcgccagcttcggcgattcgatacgttccttcgccatgcggcccagattctggttgagcaggtcgatcggcaggttgaccttttccagcacggccaccagctcgggcgcttcctcgtggaaggtcttggacaggccgaccttgatggtcacgctcttgtccacgcccggtttttcttccagcttcaccaggtcgacctggcccatcagcggggttggcgaccagtagtagaacaggatcggttcgccacgcttgtagctcgacagcaccgcggcatccagcgccgggccggtgcctgggcggaagttggtgtagctgctttccaggccgtagcttttcagcatctcgctgttgtccagctcgcaggtccagccggccgggcagttatagaaacggcctttgctcggctcttccgggtccttgaatacgctggcgtacttgcccaggtcggcgatgttcttcaggtccggggccttggcttccagcttgcgcttggcatcgccttcgatcacgtagcgcggcacgtaccagccttcgatggcgcccaccaccggggcgccgacgccgaccaccttgccggccttctcggccttgttccagacctcgctgcgaccgacccattcctcggcgaaaacctggatgtcattgctgctcagggcgttctccatggtgatggagttgcctggcaggctgtcggtcttgcagccgtagcctttttccaggaccacttgcagcacgtcggtcagcaacatgccgctttcccagttcaggccggcgaatttcaccggtttgccggactcgcaccagccggccgcctgggtagcgccggcgctggccagcaggcccatggaaagcaaagtggtcagcagggtcttattcattttcattgtgtgacgctcccaatcattgaaatggattacggcagtcaagaggcatccagcccgtccacgtccaatcaggtctagaccgcggtagcgcggcctgccccactcagcttttgttctgtgatcgagtcctgctctaccggcaggatcaggcgatcgggtacagcgccatgccatttcttcgcgcagacgtaatacagcgccgcgggaaccaccaggccgacgatccaggagatatccacgccacccagggtttccaccagcgggccggtgtagaacttggtggcgatgaacggcagctgcaccagcacaccgatcacatagacgctgataccgaggatgttccagcggccatagcgaccgttcggatcggccagcgccggcacgtcatagtgctcgcgggtgatgcagtagtagtccaccaggttgaccgcactccacggggtgaagaaggccagcaggaagaggatgaaagacttgaacgcaccgaggaacgagtgctggccgagcaaggcgatcagggtcgcggtaccaacgatgaccagcacgaacaccaggcgttgcaagcgcgtcacttccaggtggccacgaaagccactgatgatggtggcgatgcacatgaagctgccgtaggagttcagcgtcgagatggtgatcttgccgaaggcgatgctgaagtacagcagcgcggcggtggcaccgctgccgcccaggccgacgatgtaggccacttcgtggccggcgaactgcccgtcggccatggccgcggcgaacacgccgagcatcatcgccacctgcgcgccgatcaccgagcccgcaccagcggcgaggaaggttttcaccgaagaggtcttgctcggcaggtagcgcgaatagtcggccacgtaggggccgaaggcgatctgccaggacgcggcgagcgacaccgcgagcaggaagctgctccagctgaagtggcggatttccaggagtgcgccaatgtcggtctggctcatcaggcgactgaacagataaacgaaagcgatcacgccaatgacgctggcggcgcgaccgatgaaatggatcacccggtagccgagcaccgtgaccagcacgatgacactggcgaagatcaggatgccgatactgtcgctgaccccgaacagctggcccagcgcctggccggaaagcaccgtgccggtggcggtgaagcccaggtacatcaggcagaccaggacgatcggaatggccgcgccatagacgccgaactgaacccgactggagatcatctgcggcaggccgagcttgggcccttgcgccgcgtgcaacgccatcacaccgccgcccagcagttgcccgatgagcaagccgatcagcgaccagaacacatcaccgcccagcaccaccgccagagcgccagtgacaatggccgtgatctgcaggttagcccccaaccacagggtgaactggctgtagagcttgccgtggcgttcagcctcggggatgtagttgatcgagcgccgttcgatcaggggtttggagctatcgctggccgtggacatcgttattgttctcccgggagattcttgtcatgtcaaagcactgctacatggaccgagccgccgcactacagcgtgcgacggcttcttccctaatcctggcggcaatccgccgggagcttacttgccagtgatcatcggcaggttcagaccctgttccttggcgcagtcgatggcgatctggtaaccggcatcggcgtgacgcatgacaccggtacccgggtcgttatgcagcacacgggcgatacgctcggccgcttcgtcggtaccgtcgcagacgatcaccatcccggagtgctgggagaagcccatgccgacgccgccgccgtggtgcagggaaacccaggtcgcgccgctggcggtgttcagcagggcgttgagcagtggccagtcggacacggcgtcggaaccgtcctgcatcgattcggtttcgcggttcgggctggataccgaaccggagtccaggtggtcgcgaccgatgacgatcggcgccgacagctcgccgctgcgcaccatttcgttgaacgccaggccgagcttggcgcgcaggcccaggccaacccagcagatacgcgccggcaggccctggaagctgatgcgctcgcgcgccatgtccagccagttgtgcaggtgagcgtcgtccgggatcagttccttgaccttggcgtcggtcttgtagatgtcctgcgggtcgcccgacagcacggcccagcggaacggaccgatgccgcggcagaacagcggccggatataggccggtacgaagcctgggaagtcgaaggcgttctcgacgccttcttcctgggccatctgacggatgttgttgccgtagtcgaaggtcgggatgccctgcttctggaagtcgagcatggccttgacgtgcacggccatcgattgcttggccgccttgaccaccgccgccggctcggtcttggcgcgctcgcggtactgctcccaggtccagcccgctggcaggtagccgttgagcgggtcgtgggcgctggtctggtcagtgaccatgtccggacgcacgccgcgacggaccatttccgggaggatttcagccgcgttgccgcacagggcgatggagatcgccttgccttcggcggtgtacttggcgatacgtgccagggcgtcgtccaggtctttggcctgctcgtcgacatagcgggtcttcaagcggaaatcgatgctggtctgctggcattcgatgttcagcgagcaggcacctgccagggtcgcggccaaaggctgggcgccacccatgccgccgaggccggcggtcaggacccagcggcccttgaggtcatcgttgtagtgctggcgaccggcttcgacgaaggtttcgtaggtgccctggacgatgccctggctgccgatgtagatccagctgccggcggtcatctgaccgtacatggccaggcccttggcatccagttcgttgaagtgttcccaggtggcccagtgcggtaccaggttggagttggcgatcagcacgcgcggggcgttgctgtgggtcttgaacacgccgaccggcttgccggattgcaccagcagggtctcgtcgtcattcaggttggtcaggctctcgacgatcttgtcgtagcactcccagttgcgcgcggcgcggccgatgccaccgtagaccaccagctctttcgggttctcggcgacttccgggtcgaggttgttcatcagcatgcgcagcggtgcttctgtcagccagctcttggcggtcagcttgttgccgcgggcagcgcgaatttcgatgttccggtatttcgtaggtttattctcagtcacgaaaaaactcctcagcgatcaatccaaaccaacccaggcagtgggcgagcgtgcctgcgcgcagggcgctgcgcagcaagcgaatcaggggacgctgcgaagagtcttcagtgactcatacgcatacgtctttacttgtacatacaagcatatgcaatcgatcggccaactcgttgaatgagccttcaagaaaatctctggaaatgctggagaggcccttggatcaagggtttcagcgtcgattattttttcgcgggggatatgacgagaggagtgagagctgttacttcgccagggctttgcgccacgctggggcgttcggtaacaaattggtgcgcaggggggaaacaacatcagggagggagagaaacaagccttgtgtagccgctgccgaaggctgcgatccgctccgaaggagacgcgctcttgcaggccccggaggctcttcgagtcgagcgcgaccccggcctatcgcagcctgcggcagcggctacaggtcagatggctgtcagttcgatcacgcagcaagcgccgttgacgctgacttcccgcaagccggggttaccgagcagttgcaggcagtcatggcgctcaagcaacgcggcgataccgccacccaggtcggcgcgcatttcctcggcaacgctgaataccagcaccgtgccggcctgggtgaagaagcgctggccacccgacagccattgcaggcgagcgctgtagcggtccggcgcgtagatcaggttgaagtcgcgaatcggcccgtcgatcagggtgcacgcgacctggctggcgccactgaaggcaaaggggtccagcggtaacagtgcgcgggtgtcctcgccatccaccgtcagggtcatgcccgcaccctgcagcacggtaatgatccgctggtagccggcaaagctggagaagccgccggactcaccgatatcggcgatcgacagccgccagccgaaaccttccaggccgacgccggcgtcccgggtgatctcttcggtgctgccgccaccgttcttccatggcatgcgcgggtagttggccgcgcgcaaaacgttcaactgagtcattgatgccccttacttatgaaaccgcccttccaggctgtgacgagaacccgggtggatcaggcgcgcggcggtcaccggctggcggccggaccaggtccggcggcgaatcagcaggcacggctcgccgcgctcgatctgcagcaacttgcattcttccggctcggccagaatcgcctcgaccacgtgctcgccctcggtcagcggcgcgacctggttcaggtaggcgtagggggtctgcagggtgaaatcctgcttgaggtaatccggcgccaccagcgcgttgacgaaacggtcctcgatctgcaccgggatatcgttctcgaagtgcacgatcagcgagtggaagaccctctgcccttcgcgcatttccagggccacggcgcgctcggaaccggctgcctcttcccccagggtgatgaccttgcacgtgtggcgatgaccgcgcgaggcgatctcgtcggcaatgttgtgcacctcgaacagcgccgactggcttttcggttcggcgacgaaagtgcccacgccctgcatgcgcaccagcaggccttcggcggtcatctcgcgcagggcgcggttgatggtcatgcggctgaaacccagctggctgaccagctcgctttccgagggaacgcggtaatgcggcggccagtttccactctcgatctgctgggtgatcatctgcttgacgcgggcgtacaggggcgccggactatcgcccaaatgggcggccagcggggagttggcgggcggagtcggcacgggaaatccttgttggctgaagaaagaggctagcttgccggagtttaccgagcaggcaaacgtctgtatatgtatatacaaataacacacgacggggtgcttgaaccatgtccgccttctttgccgaacgcgcactgctgcctaacggatgggccaacaacgtacgtctcgaggtcagcgccgacggcctgttgacccacatccaggccgatgccagcgcagaaggcgccgagcggttacagggcccgctgctgccgggcatgcccaacctgcactcccatgcgttccagcgggcgatggccgggctggcggaagtggccggcaaccccaacgacagcttctggacctggcgcgacctgatgtaccgcctggtgggcaagatcagcccggaccagctgggcatcatcgcccgtcagctgtacatcgaaatgctcaaggccggttacacctcggtcgccgaattccactacgtgcatcacgacaccaacggccagccctacgccgacccggccgagctgtccctgcgtatcagccaggccgccagcgctgccggcatcggcctgaccctgctgccagtgctgtacagccactccggtttcggcggccaggcgcccaacgaaggccagcgccgcttcatcaacagcacggaaaactacctcaagctgcaaagccgcctgcaaccgctgctggcccggcaaccggcccagcagttggggctgtgcttccactcgttgcgcgcggtcaccccgcagcagatcagcgaggtgctggccgccagcgacaagcagtgcccggtgcatatccacattgccgaacagcagaaagaagtcgacgactgcctgacctggagcgggcgccggccgctgcaatggctgtatgaaaacaccgaggtcgatcagcgctggtgcctggtccatgccacccacgcgaatgccgaagaagtcagcctcatggcgcagagccgggcgattgccggcctgtgcctgaccaccgaagccaacctcggcgacgggattttcccggcggtggatttcctcgcccagggcggccgcatgggcatcggttccgacagccatgtgtcgctgagcgtggtggaagaattgcgctgggcggaatacggccagcgcctgcgcgatcaacgccgcaatcgcctgtatcgcagcgaccagccgatggttggccggaccctgtacgacgccgcactggacggcggcgcccaggccctggggcaaccgatcggcgccctggaagtgggcaagcgcgctgactggctggtgctcgacggcagcgatccttacctggccaccgccgagggcgacggcatcctcaaccgctggctgttcgccggcggcgatcgccaggtgcgcgatgtgctggtcaacggtcagtgggtcgtgcgcgacggacgtcacgcagacgaggaagaaagtaatcgggcctttacccaggtactgcgcgacctgctcggctgaagctagtcaccgcgggagccagcacgctggctcccgcatggattcacttcgaggtcttggccatcgccttgtccgacacgcgccagatcaggcgggtggtgtcataaccctgctggcgcgccctgctcagcaggtcctcgcgaaccgcctcgctgacattcggccgacgcgacaacagccacaggtatcgacgatccgggttgccgacaatggcggtcttgtagtcgtcgctcacatacagcacccagtagtcgcccttggccaggcccggtatcaaccgggaaaaccaggtatcgaactcgacccacagcttgtcggttttgtccggcgcctgcggcgtcgcggtgccccgcacctcttcccattgccaattggaggtcaggcagcggttgagtaccgccatattgccttcgggcaacagggtgtagcgggcttcggattgcgcgcaattgcgctggaaatacatcggcaaacgcgccagctcgtaccaggtcccttggtaacgcttgagatcgacgtgattagcggtcttgggcgccagtgaatcgtcccgggaagtggcgcaaccggccaacaacagaccggccagaagagtgactagcaaacgcatcattatttttctcccgtgggcacgtggccccggttttttacttcaggccttgcccggaaaacatcagcactttgtcaccggcgtactgcacgctgataaagctgttcttgtcaccccaggtgcagctggacatgcccagcgcgccggaacaatcggttggtttgcccagcagtttttcaacttcggccttgggcatgccggccgacagcttggaatagttttcctgattgatcttgccgcatgcagccaacagcacgcagaacgacaacagagcgagagaacgcagggacatggtgaaactcctgggcgaacggggggatggcatgctgccaaccagaagcttagaagagaaaagccccatctggttccccagccagacgcctatttattgtgacgcagcgcccagcatttcctcccgaatcaaccactttgcgggggcaaaacgcatttcgtcgggcaggcgtcggcgagcctcatctttcatgatggccagtcgacataaacacagcgcaaaagctgccgctatggcaaattgacaccccctcgctgaccaccctttcgcggtagctcacttaatgaccagaaacatgaaattcagccataagatcctgcttgccgccgctcttgtggtcgccgttgcgttcgcctgttttatcctgttcaacgactatcgacagcgcgaggccctgcgcaacagcaacgagtcctccatgcaggaactcggcagcctgaccagcagcaacatccagacctggctggaaagccgtatccagttgctgcacaccctggcccagcaaatcgccgtggacggcagcggcgccgatggcctgaaacgcagcgtcggcctccccgcctacgccagcaacttccagctcagctacttcggcggccaggacggcgcgatgttctcggtcccggcgggcaaccgcgcgcccgactacgacccgcgcacccgtggctggtacaaggcgcccaactcggcccagcagaccatcgtcaccgaaccctacatcgccgcctcgtccggcaagctggtgatcaccgtcgccaccccggtccagcaccagggcagcttcatcggcgtcgccggcgccgatatcgacctgtccaatgtcagcgccatcattaactcgctgaatttcggcggccatggccaggcgttcatcgtcagtgccggcggcaagatcctgatccacccggacagcaagctggtgctcaagaacctcagcgacgcctaccccaatggcgccccgcaggtcggcccaggcctgaaggaagtcgagctggatggccagacccagctcatctccttcacccgcgtcaacggcgtgccggcggcggactggtacgtggcactggtgctggacaaggacaccgcgttctcgatgctcagcgagttccgcacctcggcgatcatcgccatgctgattgccgtagtgatcatcatcagcctgctgggcatgctgatccgcgtgctgatgcagccgctgcacctgatgggccgcgccatgcacgacatcgccgagggcgaaggcgacctgaccaagcgcctgaccatccatggccacgacgagttcggcaccctgggcgtgtcgttcaaccgtttcgtcgaacgggttcacggttcgatccgcgaagtcgcctcggccaccggccaggtcaacgaagtcgccttgcgggtggtcagtgcctcgaactcgtcgatgttcaactccggccagcaggcctcacgcaccagcagcgtcgccgcggcgatcaaccagctcggcgccgccgcccaggaaactcgcccagaacgccgccctggcgtcgcagcactccagcgatgcgcgcaacctggcgggcgaaggccaggccgtggtcgaccagaccatcgccgccatgcagcagctgtcggcgaagatcagcgactcctgcggccatatcgaaaccctgaacagcaacacggtgaacatcgggcagatcctcgaagtcatcaccagcatctcccagcagaccaacctgctggccctcaacgctgccatcgaagccgcccgcgccggtgaggccggccgtggtttcgcggtggtcgccgatgaggtgcgcaaccttgcccaccgcacccaggactcggcgcagcaagtgcagaagatgatcgaggaactgcaggtcggcgcccgccaggcggtggacaccatgaccgaaagccagcgcgagagcacaagcagcgtcggcatcgccaaccaggccggccagcgcctgggcagcgtgacccagcgcatcggcgagatcgacggcatgaaccagtccgtggccaccgccaccgaggagcagaccgccgtggtggagtcgatcaacgtcgacatcaccgagatcaacaccctcaaccaggaaggcgtggaaaacctgcaggcgaccctgcgcgcctgcgccgacctggagcagcaagcggcgcggttgcagcagttggtgggcagtttcaggatttgaacaacatcgcgagcaagctcgctccaacagtggagcgcatttccctgtaggagcgagcttgctcgcgatagcggttttagcggcgcagaagaactagaagctggaacccggctcgcgcaggaatgccagttcctccggcgtcgattcacgtccgaggatctggttgcgatgggggaagcgcccgaagcgggcgatgattttctgatgccgttcggcgtagtccagcagatcggcgaacaccggttggtcagccagcggctgctcgtcgtgcaaggcggcgaacctggagatcgcttcgttctgcaccgccaggttttcgcaatgctcgaacaccaggtagataaagctgcgctgcatcggcgccaactggcggtcgaaatccgcggcaataccctgggccaccagcgcctgggcgcgcagatcgccggcaaagctcttgggggtttcgcgatacagcatgcgcggcagctggtcgagtagcagcaccagggccagccagccttgcgggcgttgcgcccactcggtcaatccgccggccaaggcctgttccaccagatccccgaaacgctcgcgcgcttcgaggtcctggctgtcgcgcttgccaaaccacagcctgcccttttcagccttgatgtccgcgggtttctcggccgaaccgaaccaccagtcgagcaagggctgccagggcgcggccatgggttattccttgtggtaggcggtgacgcgggcgacttcttccttcgagccgaggaacaccgctacgcgctggtgcaggccttcaggctggatgtcgagaatgcgctggtgaccgtcggtggaagcaccgcccgcctgttccaccaggaacgacatcggattggcttcgtacatcaggcgcagcttgcccggcttggatggctcacggctgtcgcgtgggtacatgaacaggccaccgcgggtcaggatgcggtgcacgtcggcgaccatcgcggccacccagcgcatgttgtagttcttgttcagcgggccttcttcgcctgccagcaattcgctcacgtaacgctgcaccggcgcttcccagtgacgctggttggacatgttgatggcgaattcctgggtggtttcaggaatggtgatgtcttcgtgggtcagcacgaagctgcccatttcgcgatccagggtgaaacccttgacgccgtcgcccagggtcagcaccagcatggtctgcgggccgtagatggcgtaaccggcagcaacctgctgggtgcctggctgcaggaaggccttttcattgagcggttcgttctggctcaggtattcgttcgggcaacgcgataccgagaagatcgtgccgaccggggcgttgatgtcgatgttcgacgagccgtccagcgggtcgaataccagcaggtacgcgcccttcgggtatttgcccgggatctggtaggcattgtccatttcctcggacgccatgccggccaggtggccgccccattcgttggcttcgagcaggatctcgttggagagcacgtcgagcttcttctgcacttcgccttggacgttttcagtgcccatgctgcccagaacaccgcccagggcgcctttggacacggcatggctgatctccttgcaggcacgcgccaccacttcgatcaggaagcgcagatcggcaggagtgttgttgctgcgggtctgctcaatcaaatagcgactcagggtaacgcgggacatggacggctccggaggaatggggggctaaaaacccgcgcagtttaacgcgagtcggggtgcatttcctcctatgagacgagatccgccacagagagttcatgcatggggttgagcgtagcccgaaatccgatccgcagacgttggcgcaggctgcgatagcctgcgccctttcgacactacggggagcgccgaacggcctattccagagccttccagatctccgtggcgtactcgcgaatggtccggtccgaagagaaccagcccatgcgcgcgctgttgagcaccgccgaacgccaccattgattgctgtcgcgccaacgctcttcgacatgcagctgggcattccagtaggagtcgaaatcggcgcacacgtggaagcggtcatagtcgaccagcgaatcgatcagcccggtgtagcgggccggatcgtccggcgaaaatactccgccacgaatcgcctgcagcacatcgttgagacgatgggaggcggcgatgtccggcaccgcgctgaattcgccattgcgtttgcgtgcctccacctgctgggcgctgaggccgaagatgaacatgtgctcggcgccgacccgctcgcacatctcgacgttggcgccgtccagggtgccgatggtcagcgcgccattgaggccgaacttcatattgctggtgcccgaggcctcgaagccggcggtggagatctgctccgacaggtccgccgccgggatgatgctttcggccaggctgacgttgtagttgggcaggaacaccaccttgagcaggccacgcacggtcgggtcgttgttcaccgtgcgggcgatgtcattgctcagtttgataattagtttggcctggtggtaactggccgcggccttgccggcgaagatcttcacccgcggcacccagtcgatttccggctcggcgcggatcgcctggtacagcgccaccgtgtgcatcaggttgagcagttggcgcttgtactcatggatccgtttgacctggacgtcgaacagcgctgccggattgaccgcgatgcccaggcgttcatggatgatcgccgccagcgcgcgcttgctgtgcaggcgttgctcggcgaactgcttgcgaaaggccgacttctcggcgaagggttcgagcttgagcaacagctcctcggggttgtccagcagctccgggccgacagcttcgaccagcatcgccgtcagcttggggttggcctggtacagccagcggcggaaggtgatgccgttggtcttgttgttgatccgctccgggtacagcttgtgcagctcggaaaacaccgtgctgcgcatcagctgggtgtgcaggccggacacaccgttgacgctatgggaaccgagaaacgccaggttgcccatgcgcacccggcggccgttgtcttcttcgatcagcgacaccgcgcgcagcacgtcgaagtcgtggatgcccttggcccgcagcgaatcgatgtgctgggcgttgatcaggtaaatgatctgcatgtgccgcggcagcatgcgttccatcaggcccaccggccaggtttccagggcttcgggcagcagcgtgtggttggtgtaggccagggtttcgacggtgatctgccaggccgcttcccaggcgatgccgtgcaggtccaccagctggcgcatcagttcggccacggcgatcgacgggtgcgtatcgttgagctggatcgccgcatgctcgccgaggctgagcaccgaatcgtgcatgttcttgtgccggcgcagcaggtcctgcagggacgcggagacgaagaagtactcctggcgcaggcgcagctcctgcccggcttcggtactgtccgccgggtagagcacccgggaaatgctttcggcccgggccacctcggccaccgcgcccaggtggtcgccggcgttgaagcgttccaggtgcaggtcttccatggctcgggcgcgccacaggcgcaaggtgttgacgctggcgccgcgccagccgaccaccggggtgtcgtaggccaccgcgcgcacggtttccgccggccaccagacctgccgggtatggccggcctcgtcggtgacggtctccacgctgccgccgaagccgatcgaatagatcacttcgggacgctcgaactcccaggggttgccgaagtccagccagtgctcggtctgctcctgctgccagccatcgacgatggcctggcggaacagaccgtgttcataacgaatgccgtagccgtggccggcgatgcccagggtcgacatgctttccatgaagcacgccgccagccggccgaggccaccgttgcccagcgccgcatccggctccagcaggcggatgcgttccatatcgacgcccaggtcgttcagcgcatcgcgcgccacgtccagcagcccgaggttgctcaggctgtcgtagagcaggcgaccgatgagaaattccagggacaggtaataaacgcgcttctgacctttgcggtagatctgccgcgtatggtccatccagtgctcgaccatgtgatcgcgcgccgccagggcgatggcttcgaaccagtcatggtcgaaggcgtggtccgggtctttgcccaccgcgtaggtgagtttggtcaggacggcatcgcgaaaagcggccacctcagcgtcacgaacttgcagttcctgagtcatgaatacgacctcgagcgagatagacagtgagcatggaattgtctgagcctagtcggtctgacaggagccaaagactctggttcggtgcgtcttgcgattgcccgagcagaggcggcgtctcccgcggcagctggcaaaaatgatgcagatgccgtgccgaccctcgcactccccttgggcaggcgtaaattccgttaaatggttgttcaaaaatccaccagtaccggtatgatcgcgcgccctgatacacacgctggaaacaagcctgatgaagtccaacctgatcgccgccgcggaaatcgaccgactcgatacctgggccaagtattccgcgcccatgtgcggctcctgcatgtccagctgctgcaccctgccggtggaggtcaagatcaaggatctgatccgcatcggcatcgtcgacgaattcgagcgcggcgagccggcgaagaacatcgccaagcgcctgcagaaggaaggcatcgtcgagcgctacaaccagaagtccgaaatcttcaccctgcagcgcatgagcaacaacgactgcctgtatctggatcgtaagagccgcctgtgcaccatttatgacaagcgcccggacacctgccgcaaccatccgaagatcggcccgcgcccgggctattgcgcgtacaagcccaagccggtggagcgcccgaccaacaccagcagccggaccctggaacgtttctgaaccccggcctgcgcctgcaaccccgttccccacgtaaccctgccgccctgtagccgctgccgagccttggcgaggctgcgaacggctgcaaagcagccgcagtacgggccagatacaccgttttacgaccgctacgcggtcgatcgcagcctcgcgggctcggcagcggctacaggacccgagctttttcacagatcaaaaaaaacgcccccggcctttcgaccgggggcgttttcattcagccggaactaaaagatcagttcttggctttcttggcagcgcgggtacgctcgccttcgtccaggatcttcttgcgaagacggatggacttaggagtcacttcgcacagctcgtcgtcctggatgaattccagagcctgttccagggtgaaacgaaccggcggaaccagggcgatggtttcgtccttgcccgaagcacgcatgttgtcgagcttcttgcctttggttgggttcacacccaggtcgttgtcacggctgttcagaccaacgatctgaccgttgtagatttcctggccgtgctcgacgaacagcttgccgcgcgcctgcagggtttccagggagtaggtcagggccttgccggtctcgaccgaaaccagtacgccgttctgacggccggacatgtggccggacttcatcggagcgtagcgatcgaagatcgaggtcagaatgcctgcaccgttggtcagggtcaggaactggttacggaaaccgatcagaccacgggctggaatgttgtattccaggcgtacacggcccttgccatccggaaccatgttgctcaggtcgcccttacgcagacccatttcttccatgaccttgccctgggattcttcagggatgtcgatggtgacgttttcgaacggttcctgcttcacgccgtcgacttcacggatgatcacttcaggacggccaacgcccatttcgaaaccttcgcgacgcatggtttcgatcagtaccgacaggtgcagctcaccacggccggaaaccttgaacttgtcggccgagtcgccttcttcaacgcgcagtgcaacgttgtacagcagctctttgtccagacgttccttgatgttacggctggtcacgaacttgccttctttaccgcagaatggcgagtcgttgacctggaaggtcatggaaacggtcggctcgtcgacggtcagtggcttcatcgcttcgacagcggtcggatcgcacagggtgtcggagatgaacagctcgtcgaaaccgctgatgcagacgatgtcgccggcagccgcttcttcaacgtccacacggtgcagaccgtggtgacccatcagcttcaggatacggccgttgcgcttcttgccgtcgacgtcgatagcgacaaccggggtgttcggcttgacgcgaccgcgagcgatacgaccaacgccgatcacacccaggaagctgttgtagtccagagcggagatctgcatctggaacggaccgtcacggtcaacggccggagccggaacgttgtcgacgatcgactggtacagcggggtcatgtcttcggccatgtcggtgtggtccagaccggcaataccgttcagggccgaggcgtagacgactttgaagtccagctgttcttcggtggcgcccaggttgtcgaacaggtcgaagatctggtccagaacccagtcaggacgcgcgcctggacggtcgaccttgttgatgaccacgatcggacgcaggccggcttcgaacgccttcttggtcacgaaacgggtttgcggcatagggccgtcttgagcgtcgaccagcagcagaacggagtcgaccatcgacattacgcgttcaacttcgccgccgaagtcggcgtggcccggggtgtccacgatgttgatgtggtagccgttccagttgatggcggtgtttttcgccaggatggtaataccgcgctctttttcctggtcgttggagtccatcacgcgctcgtcgttgagctcgttgcgctccagggtgccggattgacgcaggagtttgtctaccagggtggttttaccgtggtcaacgtgagcaatgatggcgatgttgcgtagattttcgatcacttgtgtatctcgatcagaggattcggtgtgctgacaactgctggcagcgattaacaatagagtccggcaaggccgttacagcttgacggtggcgtcggggggccggtgacgcaagccacaggcaaacagccccgggcacttagctcggtctataaacgcgcacattggcatgtccctcactgagcagatggtgagcatgcaggcgactcatgacgcctttgtcgcaatacagcaggtactggcgagtagggtccagttccttgaagcgtgcattcaatgcatagaacggcagcgcttttatctcgatgccagaaagtgtcagcgggtcgtcttcctgagcatccggatgacggatgtcgatcacgatctggcccgccagcgcctcgctgacttcttcgatctgcaaatcctggcccagttcgtcgattacccgatcgatcggcaccagtttggcccgctcgatcgcacgctcgagcaccgccatgtcgaattctttctcttcatgctccacgcgatggcgcttggcgtgggtcttggggttcaccgagatgaccccgcagtactccggcatgtgcttggcgaaatcggcggtgccgatttcgttggccaggtcgatgatgtcctgcttgtggctggcgatcagcgggcgcagcaccagcttgtcggtcacgcagtcgatgaccgagaggttcggcagggtctggctcgacacctgggaaatcgcctcgccggtgaccagcgcgtcgatgtgcaggcggtcggcgatgctcgacgcggcacgcaacatcatacgcttcaaaatgacgcccatatgactgttgtcgactttgccgaggatttcgccgagcacttcctcgaacggcacgctgacgaacagcacgcgctgggagctgccgtacttcttccagatatagtgcgcgacttccatcacgcccaattcgtgggcacgcccgcccaggttgaagaagcagaagtggctcatcaggccgcgacgcatgatctggtaggccgccaccgtggaatcgaaaccgccggacatcaaaaccagggtctgttccagggcgcccagcgggtagccgccgatgctgttgtgctggctgtggatcacgaacaaccgttggtcgcgaatttccatccgcacttcgatttccggctctttcagggaaattccggcggcgccgcactgccgacgcagctggctgccgacgtatttctccacgtccatggagctgaattcatgcttgccggcacgcttgcagcgcacggcgaaaactttccccgccagcgcctcgccaaagtgctgcttgcacttggcgacgatgtcgtcgaagtcgcccaacgggtactcatcgacctgcaggaaatgcgcgatgcccggcatgcagctcaggcgctcggtcatctccttcaaggctttcggctcgctgacggcggtttccagctcaaggttgtcccacacaccattgaccaccacggccgggtccagatcgcggagcacggcacggatgttcttggccagctgacggatgaaacgcgtccgtaccgggcggctcttgatggtgatttccgggaaaactttaacgattagtttcatgaaaacagcgcgcgctgggccagccgaaaaaggggggcgcggattatagcggaaattgctcaaggtttaaccaattaatgtgcactcggtttttcgtgcaccaaaacgggtcgcctacagataaaaacgcaacattgcggtgcgccggtttgccaatctggcccaaatagtgcccggaatgcgtgagtttggggcataaaacccaactcagggcactggcatgcaatttgctcccttgtgaggcaggttgccatggcagagtatctgcgccggcatcacccacattctaagggcacaccaacactcgcccgaagccacccggaggacactatgtcgaagtcggttcaactcatcaaagatcatgacgtcaaatggattgatctgcgcttcactgacaccaaaggcactcagcaccacgtgaccatgccggcccgtgatgcgctggatgacgatttcttcgaaatcggcaaaatgttcgacggttcctccatcgctggctggaaaggcatcgaagcctccgacatgatcctgatgccggttgacgaaaccgccgtcctggacccgttcaccgaagagccgaccctgatcctggtctgcgacatcatcgaaccttcgaccatgcagggctacgatcgcgacccacgcgccatcgccaagcgtgccgaggagtacctgaagtccaccggtatcggcgacaccgtattcgtaggtcctgagcctgagttcttcatcttcgacgaagtgaagttcaagtccgacatctccggctccatgttcaagatcttctccgagcaaggctcgtggatgtccgaccaggacgtggaaggcggcaacaaaggccaccgtccaggcgtcaaaggcggctacttcccggttcctccgttcgaccacgaccacgagatccgtacctccatgtgtaatgccatggaagaaatgggcctggtcatcgaagttcaccaccacgaagtggcgactgccggccagaacgaaatcggcgtgaagttcaacaccctggtcaacaagggcgacgaagttcagaccctgaagtactgcgtgcacaacgtggccgatgcctacggccgcaccgcgaccttcatgcctaagcctctgtacggcgacaacggctcgggtatgcacgtgcacatgtccatctccaaagatggcaagaacaccttcgctggcgaaggttatgccggcctgtccgacaccgccctgtacttcatcggcggcatcattaagcacggtaaggccctgaacggtttcaccaacccttcgaccaactcctacaagcgtctggtcccaggcttcgaagctccggtcatgctggcctactcggctcgcaaccgttccgcttcgatccgtatcccttacgtgtcgagccctaaagcccgccgtatcgaagcacgcttcccggatccggctgccaacccatacctggccttcgctgccctgctgatggctggcctggacggtatccagaacaagatccaccctggcgacgcggccgacaaaaacctgtacgacctgccgcctgaagaggcgaaagagatcccacaagtttgcggcagcctgaaagaagccctggaagagctggacaaaggtcgtgcgttcctgaccaaaggcggcgttttcagcgacgacttcatcgacgcttacatcgccctgaaaagcgaagaagaaatcaaggtccgtaccttcgtacacccactggaatacgagctgtactacagctgctgatccggtagcgccgccccacgcggcgtgacatgctacgtaacaagaaaaaaggcctccctcgggaggccttttttattgcccgcccatcgccccggagcattcccccgggctattcatccatggataatccgcgcctctcgcgccctctgtcaggcgcctcgacgaagggattcgtatgcagtggactcgttctctcggcctgatcgcctgcctggcgttcggcagcacccaggccgctcctttctatgctgataaatccctggcccacccgctgatcaccggcctggcggaaagctcggcgaccctggcctttatcaagctgggtggcagcgtcaaaggttattactcggtcgacccggacgagagccagccgcagctgctggacgacttcggcgatgccagcatcgagtcggtgttcaacatcgccctggataatgagtccctgacccgcctggtgctgttcaaacagcgtggccagtaccgcctgcatgcctatcgctatgacgaaaacgaccacctctatcggcgcttggagaaactgcagcccgccctggagcgcatcgccaaagaccgtaagaaactcgatgccccgacggtgaaacaggccctgcgccagctgacaccgctgaactacagcgtcttctatgaagactcgggtttcgacgagttcaaccagatcgaccattcggccggcaccctggtgggttacttcgaccagaacgggcagcccatcaccgccagtccgcccggagctgaccagtacagctataaaaagacctttgccgaaaaggacgggcgctttctcaccgccacctactggcgcggcgaaacgcctgcgctggagggcgaacccctgctgtacaactaccgggccagccgcatcgcctgggaaaccgaaccgcagcgcttcactggcagcgaggacgggccttccgtggcctactccaattccggcgccgttgccgcccagggggcttacgccaagggccgacgcactggcgagtggggtattgccggaccgcacaacatctggtcccagggtcgttatatcgatggcaaacgccagggccagtggagcctggccaatgagagcgaaggctacttcatgaccggcgaatatcgtgacaacctgcgcgagggccgctggaccatcaacctgacggagtccgaaatacctgagaacggtggttttgtcacttacgcccgggacctgcgcaatggccccagcgaagtgcgtgaaggcggcgtggtggtcgaacgcggcgactatctcgacgacctgcgccagggcccctggctaaccagggaaggcaccggcaatttcgaccagggcttgcgtagcggcccatggcaactcaagaccgccgaaggccatacccacagcgtcgggtttgtcgctgacaaaatggaaggcgaactgcgcgataccgacaccaagggggtattgcgggtgatcgagcactatcgcggcggcattctctggggcacccaggagggctacaacgacgccggccaactgatgtactcctacaactacgagaacggccagcgcgagggccgttcgctgatctacagcgccgatggcaaggtgctgctgtcggacatgagttatcacaatggcaacaagcaagggccctacctgaccttcctcgccgacggttcgcccgccacggtcggtcgcgtcgaaggcagcgatttcatcggcctgatgacccagctggacgagcatgggcagatattctccgccacaccccgctgccgcttcgaaagctacaggagcgaagtgcagaactgcggcatggcccgtgagttcaggcaaggccgggtcaccagtgagcgcgactacctgttcggcgagttgcaggaataccgcgaatacgatgcccagaccgggcgcaagacccgcgagcgcgtcataggcgcggacgacaaggtcagcgaaatcacctactacgacaacggccagatcgattgccaggtgaacaaggtcggcttcgagtggatgaccgtcaaccaacagcggctcaagaaccatggccaggccaagctggccggcgaacagctgtgctatcaccgcaacggcgcgatcaagagccgcgagctgatcgacaacggcttgagcgcctgccggatcgtctatgacgaaagcggcaagcagctctcttccagcccaaccggttgcggggcgcccgcgaccgccgcggccggccaatgaaccaccttgcacccggcgcttgccaggcactgcagttttgcgtgcatcatggccgccgatttgtccccacgaagccgagaccgcccatgacttcgcgattctgccttgccctgttgaccctgttgctggccggcaatgcctgcgccgcccctgccaccctcggcccgctgttggccagcatcgaagaacgcctggccatcgccgaccaggtggccctgagcaaatgggacagccacaaaccggtggaagaccgcccgcgcgaacgtgaggtgattgccggcgcggtggcccaggcgccggcctacaaactcgacggcgcggcggtggaacagttcttcgccgcgcagatcgaggccaacaagctggtgcagtacgcccatctgtccgaatggaccttgcaaggccaggcaccggacgccccgcgcccggacctggtggggcagatccgcccgcaacttgaccagttacaaaaacgcctgctgcagcaactggcggatttcagcccccaccgcaatgacccgcagtgcccacaatggctggcccaggccacccacgaaggtgatcgggcaccactgcgccaactggcgctggtccgcgccaccgccgagctttgtgtgttcaaaggttgaagcggcgaacctgggcccggtccgcggctctatgctggaggcacttccatccttgaagccgccgaccccagcgcccaggaaagccgccatgcgtgtgcactgcctttatctgctgttgctggccgccctgccggccgccgcgcagatctaccgctacaccgatgcccacggcaacaccgcctacagcgaccagccgccggccggcgtgcccggccaggccgtcgagctcgcgccgctgaatcgcattgaggcaccccggccgctcacaccgcccggcgtcgagcctgaacaaacgcccccctccaacgcaccggcctatatcaccctggagctgagcggcgtaccgaacggcggcgtgatccgcgccaataacggctccttcaatgtcgaggtccgtctgcaaccgtccctgcacaacgagcatcgcctgcgcctgctgctggacgaccaaccctatggccaacccggcaaccagccaagcctgcaactggtgaatatcgatcgcggcgaacaccgcctggcggtgcaggtgctcgatggcgagcgggtgatccagcaaagcccggcgctgaccttcaccctgcaacgggttcatcggccctgaggtgttgtcgcgcctgaatctgcgaatacaggcgccgctcatgctcgagcaaccagcgtttgcgccagagcccgccgccataaccggtgagcgaaccgtcggcaccaatcacccggtggcaggcattcacgatggcgatctgattggcgccattggcccgggccacggcccgcacggcggaggccgaaccgatgccgctcgccacctcggcataactgcgggtagtgcccggcgcgcaacaacgccgagcggtagatccgcctcaggcgcgctcgatcaccatggccacgccctggcccacgcccacgcacaggctgaccacggcgtaacgctggttgttgcgctgcagggtgcggcaggcgctcaacaccagccgggccccggacgcacccagtgggtggccgatggcgatggcaccgccattggggttgacccgcggatcgtcgaaaaccaggcccagggccttgaggcaagccagcacctgtggcgtgaatgcctcgttgatctcgatcaggtcgagctgctccaggccgatgcgggcccgctgcagcgccagcagaatcgccctgtgcgggccgatacccatgaactgcggctccacgccgaccgacgccgatgagaggattcgcgccatgggcgcgaccccatgttccctcccgatctcacggctgccgagcagcaacaccgccgcgccatcgttgatccctgaagcgttgccggcggtcaccacgccctccgcgaacagcgtcggcaagcgcgacagggccgccaggtcggagccggggcgcggatgttcgtcatcacagacggtcgaggccgggcccttgcgcccggccgtcacctcgacggccatgatctcgccgtccagcaccccggccagcaaggctgcctggtaacgcgcctgggaagcggcggcgaagcgatcggcgtcctcgcggctgatggcatagagtcgggccaggttgtcgccggtctcgggcatgctgtggttgccatagcgctccaccagccgcgggttggcgaaacgcgcgccgatggtgctgtcggccacctcctgggtccggctgtaggcactctcggccttggccatgatgaagggcgcccgggacatgctctcgaccccgccggccaggtacagccggccttcgccgcaggtgattgcccgggccgcgtcgatcaccgccgacaggccgctggcgcacaggcggttgaccgtctgcccgggtacgcgccaaggcagcccggcgctgagcaaggcattgcgcgccaggttgcggctgtcctcgccggcctggttggtacacccgaggatcacctcttccagcgcctcggccggtagccccgaggtttccagcaaacgcaccagcaacggccccaccaggtcgtccgggcgcacgctggcgaggctgccgccatgccggccgaagggggttcgcaagccgctgtagatataggcatcgagcatgaaaggactctcgcagcagtagggatcggcaggcctcaggccggcagcgggttttccggctggcgcagggacaggcccagcagggcccgacggcgcaaccagccgctggggcgataacgcgggtcgcccgtgagtgcgtgcaggcgctcgaggatctgcagcaggcgctcggggcccagttggtcgccccactccagcggccccagcggatagccgagacccaggcgtaccgccgcgtcgatatcggccaccgaggcgatgccctgctgggcgatatcgcaggccaggttgacgatcgacgccagggtgcgctggacgatgaagccgcagctgtcgcggatcatcgtcaccgtgccgccatcggcgctgaacagcgcgtgggcggcgtgctgcatgtcttcgcgggtcgccgggttgagcatcaggcagcgctggctgtcgagcgcggtcagggtatcgattgccacggtgcgcgacgggtccgtggcatggcgcagggccgcctcggtggcgtcatcgcccagtggcgccaccaggcacaaggccgaagtggaaggtcgcaggccgttctcgacctgggcccccaggcgttcgagcaggtccagcagacgcagccggccgacctcgtcgtcggcaacgatccacaccggcggcagtgccgcgcagtggggcacggcctgtggcgggcgccgcgtatcgcctggctcgtcgtagaggtagaagccctgcccgctcttgcgccccaggtgcccacccgccagcatcagccgcagcgcgggatgcggccgataacgtggctcctcatagaactgccggtagaccgactccatcaccggcacgctgacatccaggccgatcaggtcgagcagctcgaacggccccatggcgaaaccggcgctgtcgcgcaacaccgtatcgatcagccacgccggggccacgccctcgctgaggatgcgcagcgcctcggtgccaaacgcccgcccggcatggttgacgataaaaccgggagaatccttggcccgcgccgggtagtagccgatggcgcgcaccagttcctgcaagcgagcgccgacgctagtggcaaggccgtcgatcacctcgacaatgcgcatccgcggcactggattgaaaaagtgcaggccggcgacgcgctccggatggcggcaaaccgaggcaatcgcggtgatcgacagcgacgaggtattgctcgccaggatcgcgctcggcgccagcacctcttccagttgccgaaacagctgctgcttggcctccaggtcctcgactatcgcctcgatcaccagttggcagtcatgcagcgcttgcaggctgtcgaccacttccaggttgagcatggccgccgcggcgtcctgcggggtgatgcgggccttctcgatctgctgggcgaagatcgtcgccagctgttcccgggccgtgcccgcggcccccgggcgcgcatcgaacaaaaataccttgagcccggccatggccatgacctgggcgataccccggcccatggctccggtgccgaccaggccgatgcgttgcaatggttgtgtggtcatttcccctggtactccggtttgcgtttctcaagaaaggcctgcatgccttcgcgttggtcatgggagccgaacagcagctggaaagccttgcgctccagcaccaacgcctgctccaacggcaggtccatgccggccagcaccacctccttgatctgcgccacggccagcggcggcatgccggcgattctggcggccagggccagggctcgcggcagggtttcgctgtccgccaccacctcgctgaccaggcccaggcgcagcgcctcgtcggccgggacctggcagccggtgagcagcaggcgcagcgcctggaacttgccgatggcgcgcagcaggcgctgggtgccccctgccccgggcatcaccccgaccttgatttccggctgggcaaaacgcgccgagtggccggcgacgatcaggtcgcaatgcatcgccaactcgcagccaccgcccagggcgtagccattcaccgcggcgatgaccggcttgcggcacgccgagatggcttgccagtggcgctcggcatgccgggcatagagttgcagcgcgctggcgttcaccagctcgctgaggtcggcgccggcggcaaacaccgtatcgccgccggtgagcaccacgacccgggtctcggggcaggtatccaggcggcgaaagtgctcggccagctcctcgcgcagcgccatgttcagcgcgttgagggcctgcgggcggttcagccgcagcagcgccacgcccggcgcggggcgctccagcaggaccaggggttgagggctaacggactcggaattcatggagtctcctgatgcagataggaacctgagaagtgcgccagaggcccggccgggcctctgggcgcagcccttcactcgcggacgatgccgtgctcgaacaggttttcgattgtctggttgtcgaggcccaggccttcaagaacctcgcgggtatccgcgcccaacgccggcggggcactgcgataggtggccggggtccgcgacagcttcaccggcgagccgacgccgcggtagtcgccgatctccaccagcaggccgcgatgccgggtatgcgggtgctcgaccaccttgtcgatggaggcaatcgagccgcagggcacgcccaggcggatcagccgttgcgccagggccgtgccgtcgtgctcggccaggcgcgcctccagcgcctgcttcagcgcctcgcggttgaccgagcggcagccgttgtcggcaaagcgcgggtcgtccagcaaggcgccggcgtccagctgttcgcacaacttggcgaactgccggtcattgccgaccgccaggaagatcggctcggtgccggtgcggtaactgtcgtagggggcgatattcggatgggcgttgccggtgcgctgcggggtcttgccggcggcgaaatagttggccagatgcgggtgcagcagggacacgccgcagtcgtacagggtgatgtcgagggactgccccaggccgctgcggtggcgttcgttgagcgccaggagaatccccgccagggcattgagcccggtgaccatatcgacgatcggcaggccgatgcgcagcgggccgctgtcggcttcgccgttcacgctcatcagcccggccattgcctggatcaccgcgtcgtagccgggcagcccgcccagcgggccgtcactgccaaaaccggaaaccgcgcagtggatcagggtcgggaaacgctggctcagcacctcggcataaccgatgccccaacgctccagggtgccgggcttgaagttctccatcagcacatcggcgtcttccagcaggcgcatcagcagctggatgcccgcgggccgggacaggtccacggcgatcccctgtttgttgcggttcacgcccctgaaatacgaagcgtcggcgccttcgaaaggcgggccccagccgcgggtctcgtcaccgttcaggggctccagcttgatcacatcggcgccgtggtcggccagggcctgggagcagtagggcccacccagcacgcggctgaggtcgatgactttcaggccggccagggccccttttgaatggttcatggcagttctctgacaaaaatggacagggccgttcaggccggcaacagctgcatcgcatcggctttcgacagcgcgctttcctgggccaggagcgccagcagctcaggctcaatcgatacctccggacgcagcggatcgcggggcagcagcttgtgctggagcaacaggtgggccagggccaggcgccggtaatcgggggcctggcggctcgcttcccaggccatgaagatcgccgttgcggtgtgataaagggcactgccggccaggcgcacctggtcgtcgcggcgctcttgcgcgaccttttcgatggccgcgaccgcacgttgcaggaccgtctcgaacaggcgctggctggccgccggcaggtcagcctcggcgagcaggccggcgaggtagtgccgcagcggctccagggcctgctcgcgggtcacggcgcgggcgatatccagcgcgacgatgttgctgtgccctcccagatcgagcccaggtgggcatcgcgcaccagccgcgcatcgctccactcctcgatgtagccaaccccgccgcgtacttccatggcgtccccggtgacccgacgcgcatcgcggcaggcgcggaacttgatcagcggggtgaggatgcgcacgcacttgcgcgccgcctcgtcgccggcatcggccttgggcagcagcgtggcgatctgcatgaacatcgaacgggcctgctcggcgggcagcatcattttcagcagctggcgttgcatcagcggcatctcgatcagatggcggccgaaggcccggcgctggcgggcgacatacagcgcctcattgatcccgcgacgcatcagcccggcggcccgcaccccgttggacaggcgcgacatgttgatcatgtcggccatctgctggaagccgcggccgacttcgccgatcaggtaggcggtggcgccgtccaggctgatttcaccgctggccatggagcggctgcccagcttgtccttcaggcgcaggatccggtaggcgttgcgcgaaccgtcggggcggaccttcggcagcaggaacaggctgacccccttcatgccttccggtgcgtcttccggacgggccaggaccatggccaggtcggcgtccgggttggagcagaaccacttgtcgccgaacagccgccattcgccgttctccagacgcgcgcgggtttcggtgcgcgacacgtcggagccggccgcctgttcggtcatgaacatcgcgccctggaacaagcggtcgaaatcccgcgaggccagggacggcaggtagcgcgccaccagctccggcgagccgaatttgcgcagggtgcgggtcagcgagtcggtcatgctcaccgggcagcacaggccgaactcggcctgcacgaaaaggaaggtcagggcgtacttgaccagcggcagcaccggctcggcgcaatgactcatggaggccaagctcagctcggcatacgccgcgcgctccagggcgatgaaatccgggtgcttgtaaatgctctgcaggtcttcgccacggcgggtacgcggccgcagttgcggcgggttcttgtccgccgagagcgccagcacatccagctcgccaccggcccgcgcaccgagctggcgcaagctcggcaaccactgggcgtacagttgcggcgccaggtagaccttgagcagggccgccagcccggcatcgcaatcgaacaggttcaggcctcggctatcggggatattcagggtgtcttggatgggttcaggcagggcagtcatgacgtctctccaggctcttgtgccccgagactagagtcgccatcgataagtatctaatacaaaatcaatcaactacgataagaaaaccagatcgtaaagcgaggacgccagcatggatctcaagcagcttcgttacttcgtcgcggtcgccgaagagctgcatttcggccgggccgccgctcgtctgttcatctcccagccggccctgagcttcgacatcaagaagctcgaaagccagctggacgtgcagttgctgagccgcaacaacaagtcggtgagcctgaccaacgccggccaggtgctgctcgacgaagcccgctacctgctgctgcgggccgagcaggcgcggcgcctgaccctgcgctcggcccagggtttcgtcggccggctgagcatcggtttcgtcaactcgatcctgcatcgcggcctgccgcaagcggtgaggaccttcgagcaggatcacccggacaccgagatcgtgctgatggagatgaacagcgccgagcaggcccaggcgctgcagcgtgggcagatcgatatcggcttcgtgcactggagccactttcccgagagcatccgcggcgagccggtcctcgccgagcccttcctctgctgcctgccccagggtcaccggctggcggacaaggcgcgcatcgacctggcggaactggccaacgatgacttcatcctgttcccacgcaatgtctcgccgcactaccacgacctgatcatcgcccgctgcgtggcggccggcttcagcccgcgcatccgccacgaaacccggctctggcaaacggtggtggcgatggtggggtatgaaatgggcgtggccctggtcccgcagaccctggccggcacctggaaggagggtgtgcgctactgcgaaatcagcggtgacggggcgttatccgagattcacgccatccgccatgcggacaacccgtcggccgccgcggagagtttcctgactgtgctcaaggccctgcaaaagcccgtggcgccggggctttgagggcctgcgaccatacgaaatcccgtatcacacaataagatttaatcattatttttttcattcctgcctgtataggctccgtgccgtcggaccttgcaagtacgtgatgcgcccattcgtgcaacgagtatccggagccgtcgtcagacgaacctcccgcggcgcaaataacaataacaacatgcaggaattgaatatgaatgccgcccagcatgctgccgcgcacaagaaagcccgcaaggcgggagtcgcctcgttcatcggcacgaccatcgaatggtatgacttctacgcctacggaatcgccgccgcgctggtcttcggcaaggtgttcttccccgccgacctgcctgcgggcaccgccaccctgctgtcgtttttgaccctctgggccggcttcatcgcccgccccatcggcggcatcatcttcggccacctgggcgacaagatcgggcgcaagaccaccctggtgatcaccctgatcatgatgggcgtggccaccacctgcatcggcctgctgccgacctacctgcagatcggcatctgggcgccgattgccctggtgctgctgcgcatcatccagggcatcgcggtgggtggcgaatggggcggcgccatcctcatcgccagcgaaagcgcgcccaagggcaaaggcattctgtatgcggcgttcgcccaacagggctcgccggccggcaacctgctggcgaccctggtgttcttcggcctcagcgccctccccgcgccggactttttgctgtggggctggcgcattccgttcctgctctcggcggcactggtcctggtgggcatggtgattcgcctcaagctcgaagagtcggacgacatgaagcgcctgatccagcagaaaaagaccgtcaagctgccgatcctggaggtcctgcgcaaacactggcagatcgtgctgctgggggccggcgtgctgccgatcatccatgtcacctacttcaagagcacctttgccctgtcctgggccaccaaggagctgggctacagccagagcacctttctcagcgtaatcgtcatcgccctggtggtgcagttcatcacccagcccctgggcgcggtgctggtttccaggatggacatgcgcaaggccgtggtgctgatgctgctgccggagttcttcctgatgccggcgatgttcttcgccgtggaaaccggcgtctactggatcgccgtgctcggcatgtgcctggccaccgtgccgcactcgatgttctatggcgccgtcggcggcatcctggcccacgcctttccgaccagggtgcgctacagcggcctgtcgatttcctaccagctctgttccttgctggtgggcggcgccacgccggtcctggcccagggcattctcaacaacaccgggagcattctcggcgtggccatcgcctccgctggctatgccgtggtgtccctggtgtgcatgctcctgctgctcaagcacatcggccacaacgccgccgacctgtccaccgccgagcaggcggacgccgacgaactggcccgggaaccccgtgccacgccgctgaccgaggcccccgccacgctaccaccgggtatcgacaaggacgcccagcccgcccactgacccgccatccgccgcacgcttccaggcccgccagcaagcgggcctttttgcgtgcgcggcgaattctggaccggcgcgcggctggctattctttagcgcagcctcggataaatcgcactatattggtgcatcaaactgcacacgcccccatccacagcccattttggttcgaaagtacccagcgcagccggcaaaacgctgcgaaacagaactttaaacgtccgtttcagggctcgagcgcttcttttcggagccttggtttggtttttgcattttctcgataccagcgccttattcgcgcgcgcaatcctgggccggcccgggattgccttgtttcaaaagaggtcaacatttacccatgaccatcagcgatcaactgcaccgcttgctactcgacaacctgaccaccgcgaccatcctgctcaacgccgacctgcgccttgagtacatgaacccggcggcggagatgttgttggccatcagtggccagcgcagccatgggcaattcatcagcgaactgttcaccgagtcggccgaagccctgagctccctgcgccaggcggtggaacaggcgcacccgttcaccaagcgcgaagccatgctcaccgcgctgaccggccagaccctgaccgtggactacgcggtgacgccgatcctgagcaatggcgacaccctgctgttgctggaagtccacccccgtgaccgcctgctgcggatcaccaaggaagaggcccagctgtccaagcaggaaaccagcaaaatgctggtgcgcggcctggcccacgagatcaagaaccccctcggcgggattcgcggcgccgcccagttgctggcccgcgaactgccggacgagaacctcaaggactacaccaacgtcatcatcgaagaggccgaccgcctgcggaacctggtggaccgcatgctcggctccaacaagctgccgtcgctggccatgtgcaacgtgcacgaagtgctggagcgcgtgagcagcctggtggaagccgaaagccagggctgcatcaccctggtgcgcgactacgacccgagcattcccgatgtgctgatcgaccgcgagcagatgatccaggcggtgctcaacatcgtgcgcaacgcgatgcaggccatcagcagccagaacgagctgcgcctgggccgcatcagcctgcgcacccgcaccatgcgccagttcaccatcggccacgtgcgccaccgcctggtgaccaagatcgagatcatcgacaacggcccggggatccccgcggaactccaggaaaccatcttcttccccatggtcagcggccgtccggacggtaccgggctgggcctggccattacccagaacatcatcagccagcaccagggcctgatcgagtgtgacagccatcccggccacaccacgttctcgatctttctgccactggaacaaggagccccatcgacatgagccgtagtgaaaccgtgtggatcgtcgatgacgaccgttctatccgttgggttctggagaaagccttgcaacaggaaggcatgaccacccagagcttcgatagcgccgatggtgtgatgagtcgcctggcccgccagcaaccggacgtgatcatctccgacatccgcatgcccggcgccagtggcctggacctgctggcgcggatccgcgagcagcacccgcgcctgccggtgatcatcatgaccgcgcattcggacctggacagcgctgtcgcctcctatcagggcggcgccttcgagtacctgcccaagccgttcgatgtcgacgaagcggtgtccctggtcaagcgcgccaaccagcacgcccaggagcagcagggcctggaagtgatcccggcgctggcccgcaccccggaaatcatcggtgaagcgccggcgatgcaggaggtgttccgcgccatcggtcgcctcagccattccaacatcaccgtgctgatcaacggtgagtccggtaccggtaaagagctggtggcccatgccctgcaccgccacagcccgcgggcggcttcgccgttcatcgccctgaacatggcggcgatccccaaggacctgatggaatccgagctgttcggccatgaaaaaggcgccttcaccggcgcagccaacctgcggcgcgggcgcttcgaacaggccgacggcggcaccctgttcctcgacgagatcggcgacatgccggccgacacccagacccgcctgctgcgggtgctggccgatggcgagttctaccgggtcggcgggcatacgccggtcaaggtcgatgtgcgcatcatcgccgcgacccaccagaacctggaaaccctggtgcacgccggcaagttccgcgaggacctgttccatcgcctgaacgtgatccgcatccatatcccgcgcctgtcggaccgtcgcgaagacattccgaccctggccaagcacttcctcagccgcgccgcccaggagctggccgtcgagcccaagctgctgaaaagcgagactgaggaatacctgaagaacctgccgtggcccggcaacgtgcgccagctggagaacacctgccgctggatcaccgtgatggcttcgggtcgcgaggtgcatatcagcgacctgccgccggagctgctgagcctgccgcaggattcggcgccggtgaccaactgggagcaggccctgcgccagtgggccgaccaggccctggcacgcggccagtcgagcctgctggacagcgcggtgccgagcttcgagcggatcatgatcgagaccgccctcaagcatacagccggccgccgacgcgacgccgccgtgctgctgggctggggccgcaacaccctgacgcgcaagatcaaggagttggggatgaaggtcgacggcggggatgacgacgacagcgacgagggctgagccgcgtaatcccctgtagccgctgccgcaggctgcgataaggccgaaggccttcagcgattttgagatcctgcgcgcccttcggtcgcgatcgcagccttcggcagcggctacagggcaaggcattcgtgctgtgtcgagtgacagggccaatcgcgggcaagcctcgctcctacagatgcggtcgtgggagcggggcttgcccgcgatgctttttgtgcaccgcaatggtgagcctgcactgcccgaatgcgcagctgggcgtgggatttccccgtgggcgatctcgatttttctcgcaagaacatatccacaaaacggcgaaagccccgtaaaccggggctttcagctttccttgaaaattcgcttaaccgtttaagccagaattggcacgccccctgcaaagacaagatcacgagtgcagtcactcacccgttttggggaccttggtacaggcaggccgagactccccttctttacacccggaacccataccgctcgcagcgacgggttccaaccggtttggggaaccctggtacaggcaggccagggattccctctttacaccgggcccagcgcaatcagcgcggccctcacgcttttgggaaccttggtacaggcaggccggggcttcccctctttacaccgggcccggcgcaatcagcgccccgccctcatgcttttggggaccttggtacaggcaggccgggaatcccctcttttattcctcgcgcagctggatctccaggcgccagcgcccgtcgacctcgctgcccgaccattcggcgtgcagcgctcttgctgcgaccacgttcagcagcaacccttcctcagccgcccgcacccgccagttggcatccttgtcgttgatcttcaactggcccttctgcgcccgtccctcggcctcgaacaacagcgccacggccccgtcgatgtgctcgccatgaaccttgggctcgttgttgaaccacaccaccagggcattgggccgggcctgcacttcctgcaactcggtggggtccggggtcgtcaggcgaccaatcatcaacccgaccatcacgccaaagatcgccagcgagccgaatacccgcagcattagcttcggccggacgtccgcttcaggcgtagaatgcggcctgtctttttcttcggagccgtgcatgtttcacgtcatcctttttcaaccagaaattccgccgaataccggcaatgtaatcaggctgtgcgccaatagcggctgccacctgcatttgatcgagccgctgggtttcgaaatggacgacaagcgcctgcgccgggccggcctcgactatcacgagtacgccaccctgcagcgccatgccgacctcgccagctgtcttgaaagcctaggccatccgcgcctgttcgccttcaccaccaagggctcgcgacctttccacgacgccagcttcgccgagggcgatgccttcctgttcggcccggaaagccgtggcctgcccgccgaggtactggacgccctgcccaccgagcaacgcctgcgcctgcccatgcgcgaaggctgccgcagcctgaacctgtccaacaccgtggcggtggccgtctacgaagcctggcgccagctgggcttcaaataagcccccacctccgactccttgtagccgctgccgcaggctgcgataaggccgaaggccttcagcgtgttcaagacctggcgcccccttcggcggcgatcgcagccttcggcagcggctacaggttcggcgccgactatcggcatcagtctcgaaaccttgggcccgaacatgaaaaaagcgcctgaaacggcgcttttttcatggaacccggcagcttattgaacggtgccttcaccggccgcctgcaggcgttgcagctcttgcgcgtacagcgcgtcgaagttcaccggagccagcatcagggccgggaacgaaccgcgggtcaccaggctgtccagcgcttcgcgagcgtacgggaacaggatgttcgggcagaacgcgcccagggtgtggctcatcgaagcgtcgtccaggttcttgatcaggaagataccggcctgttgcacttcggcgatgaacgccacttcgtcgccgttcttcacggtgaccgacagggtcagcacgacttcgtggaaaccctcttccagcgccttctgacgggtgttcaggtccaggccgacgctcggctcccactgctggcggaagatcgccgggcttttcggagcttcgaaagacaggtcacgcacatagatacgctgcagcgagaattgcggtgcggattcgtcttcggtcgcagcggtgttctgttggtcagtcatctcagatccttcttgatctcggggtcatgtagggtttgctgaacttgggtggtcagtcaggccgcgagcagcgcgtcgagcttgccggcgcgctccagggcgaacagatcgtcacaaccgcccacatgggtgctgccgatccagatctgcggcacggacgtgcgcccggccttctgggccatttcggcacgaacctgcggcttgccgtcgaccttgatctcttcgaaggctacgcctttgttctcgagcaggtacttggcccgcgagcagtaggggcagtaatcgctggaatagacgacgacagtagccatatcacttcaccagcggcaggttgtcggctttccagctgccaacgccgccggacagcttggcggcggtgaagccggacttcatcagctcgcgagcgtgggtgccggcgtgctgacccagggcgtcgaccagaatgatggtcttggccttgtgcttttccagctcgcccacgcgggcggccagtttgtcttgagggatgttcaacgcgccgacgatatggcccgcggcgaagtccttggtcggacggatatcgatcaccacgccctgctcgctgttcaccagcgcggtcagttcacgggtgctgaggctgcggccgccgcggctcagctcgtgagcgatcaacagagccagcaagatgacgaaggcgccgacgagcaagtagtgttcagtggcgaattgaatcaggtgagcaaccatcaaggaggttccagggcgttaaaatgtcggccagtatacacagccctccgggtcggccaaaccccgcccggcggtgacgccaccggaacttggctataggacgtgttgaccctcaatggcgatcgcgccgccgccccgtaaaacgcaagactaggcatgaggagcgtggtttggcgtttcaaataagcgacgaataacgacggattgcgctttacggggcgcggccctccgggtttgcgctgtgagcgcgccaggctgcgttgcgggacttggcaaggaaacaacccttaccctcgtcccgcgccttgcctggcacgctcacagcgcaaacgcgactcgccattgagggtcaacacgtcctaaactgctactccctttttccaacattctcccaatccagccacgagtggaatctatgactaccacgcctaaacctttggtcctgatgattctggatggcttcggtcacagcgagagccacgaatccaacgctatctatgcagccaagaagccggtcctcgaccgcctgtgcgccagcgtgccgaacggcctgatctcgggttcgggcatggatgtcggcctgccggacggccagatgggcaactccgaagtcggccacatgaacctcggcgccggccgcgtggtgtaccaggatttcacccgtgtcaccaaggccatccgcgatggcgaattcttcgagaacccgaccatttgcgccgccgtggataaagccgtggccgccggcaaggccgtgcatatcctcggcctcctgtccgatggcggcgtgcacagccaccaggaccatctggtggccatggccgaactggccttcaagcgtggcgccgagaagatctacctgcacgccttcctcgacggccgcgacaccccgccgaaaagcgccacctcgtcgatcgaactgctggatgaaaccttcaagaccctgggcaagggccgcatcgccagcctgatcggccgctacttcgccatggaccgcgacaaccgctgggaccgcgtggcccaggcctacaacctgatcgtcgacggcaagggcgaattcaacgccgccaccgcccaggaaggcctgcaggccgcctacgagcgtggcgaaagcgacgagttcgtcaaggccaccaccctcggcgagccggtgaaagtcgaggacggcgacgccgtggtgttcatgaacttccgcgccgaccgcgcccgcgagctgagccgggtgttcgtcgaggacggtttcaaggaattcgagcgcgcccgccagccgaaactggccggtttcgtcatgctgacccaatacgcggcaagcattccggccccttcggcctttgccccgggcagcctggaaaacgtgctgggcgattacctggcgaaaaacggcaagacccagctgcgcatcgccgaaaccgaaaaatacgcccacgtgaccttcttcttctctggcggccgcgaagagccgttcccgggcgaagaacgcatcctgatcccgtcgccgaaagtcgccacctacgacctgcagccggaaatgagcgcaccggaagtcaccgaccggatcgtcgacgccatcgaaaaccagcgctacgacgtgatcgtggtcaactacgccaacggcgacatggtcggccacagcggcgtgttcgacgccgcggtcaaggccgtcgagtgcctggacctgtgcgtcggccgtatcgtcgatgccctggaaaaggtcggcggcgaagccctgatcaccgccgaccacggcaacgtcgagcagatgtccgacgcttccaccggccaggcccacaccgcccacaccagcgagccggtgccgttcatctatgtgggcaagcgcgacctgaaagtccgtgaaggcggagtcctggccgacgtggcgccgaccatgctcaagttgctgggcctgccgcagcccgcggaaatgactggcacttcgatactggtctgatatcaaaaagaccgaataatgggccgcaaacggctttttatgacgaacgcctcaaagcagttggctttgaggcgttttttttgcagcgaggggcgggcatactaggccgtccctttccctggtgtcgcccgcctctatgcttcgcgccctgattacccttgctctgatctgcctgctccaaccggccttcgccgacgagcgcgcgcaaacccaacagcagttggacgccacgcgtcaggatattgccgagctgaaaaagctgctgggcaagctgcaggaagaaaagtccggcgtgcagaaagacctgcgcggcaccgaaaccgagatgggcaagctggaaaagcaggtcgatgccctgcaaaaagaactgaagaaaagcgaatccgagctgcagcgactcgatgaggagaaaaaaaaactccagagcgcgcgcattgaacagcaacgactgatcgccatccaggcccgcgcggcctaccagaatggccgccaggagtacctcaagctgctgctcaaccagcagaacccggaaaaattcgcccgcaccctgacctattacgactacctgagccaggcccgcctggagcagctgaagaatttcaacgagaccctgcgccagctggccaatgtcgaaaaggaaatctccctgcagcaagcccagctgctggtgcagaaaagcagcctcgacacccagcgtgaagaactcgacaaggtccgcaaggaacgccaggtggccctggccaagctcaatgacgacgtgaaggcccgtggcgacaagctcaaggcccgcgaacaggaccaggccgatttgggcaaggtcctgaaaaccatcgaggaaaccctggcccgccaggcccgcgaggcggaagaagcgcgacagaaagcgctgatcgcccagcaggaagccgaaaaaaagcgtttgcgtgaggcccaggccagtgccgacgagagcccgagcaagccgccccgagcgacgcccggccccttggtttccagcgcaggcgcctcctatggaggcccttttgcttcatcccggggaaaacttccatggccggttgatggtcgactgctggcgcgcttcggcgaaagccgcggcgacgatgcccggaccaagtgggacggggtgatgatcagcgcctcggccggcagccaggtgcatgccgtccatggcggccgtgtagtgttcgccgactggttgcgcggcgccggcctgctggtgatcctcgaccatggcaacggctacttgagcctctacggacacaaccagacgctgcttaaagaagcgggcgatatcgtcaaggccggcgagtccatctccactgtcggtagcagtggcggacagggcgcgccggcactgtacttcgctattcgccagcagggtcgcccaagcgacccggcacaatggtgccgcgcgcaaggataagcgcgccatctcattcaggagttcgttcgacatgctgcatttgtcccgcctcacctcgctggccctgacgatcgctctggtgatcggtgcgcccctggcgttcgccgccgaaaccgctcagtcggcagccgccacgaccaccaaggcgccattgccgctcgaagagctgcgcaccttcgccgaggtcatggaccggatcaaggccgcctatgtcgaacctgtcgacgacaagaccctgctggaaaacgccatcaagggcatgctcagcaacctcgacccgcactcggcctacctcggccctgaagacttcgccgagctgcaggaaagcaccagcggcgagttcggcggcctgggcatcgaagtcggcgccgaggacggcatcatcaaagtggtgtcgccgatcgacgacaccccggcgtccaaggccggcatccaggccggcgacctgatcgtcaagatcaacggccagccgacccgcggccagagcatgaccgaagccgtggacaagatgcgcggcaagatcggccagaagatcaccctgaccctggtccgcgacggcggtgcgccgttcgacgtgaccctggcccgcgccaccatccaggtgaagagcgtgaagagccagctgctggaatcgggctacggctacatccgcatcacccagttccaggtcaagaccggcgaggaagtctccaaggccctggccaagctgcgcaaggacaacggcaagaaactcaacggcatcatcctcgatttgcgcaacaacccgggcggcgtgctgcaatcggcggtggaggtggtcgaccacttcatcaccaagggcctgatcgtctacaccaagggccgcatcgccaactccgagctgcgcttctccgccaccggcaaggacgaaagcgaagcggtgccgatggtggtactgatcaacggcggcagcgcctcggcttcggagatcgtcgccggcgccctgcaggaccagaaacgcgcggtgctgatgggcaccaccagcttcggcaagggctcggtgcaaaccgtgctgccactgaacaacgaccgtgcgctgaagatcaccaccgcgctgtacttcacgccgaacggccgttcgatccaggcccagggcatcgtgccggacatcgaggtgcgccgcgccaagatcaccagcgaagcgcaggacaacgaatacttcaaggaagccgacctgcaaggtcacctgggcaatggcaacggcggcgccgacaagccgaccgcttccggcagcaagcccaagccgatgccgcaggacgacgactaccagctggcccaggccctcagcctgctcaagggcctgagcatcacccgcagcaagtgatggaagccatcgcgagcaagcccgtcgcctcctctgcaggagcgaagcttgctcgcgatggcgccctgatgaccgccacaccccgccaaggctttacccgaaccctatgcttcaaacttccatgatcactcaccgccaacccctcccacggttgtcgtggaggctcatgatcgggcttctgtgcctcctcgccttcacctctctccaggccgccgagcccgccccgcgcaaggcctacctgagcctgatcatcgacgacctcgggcagaacctgccccgcgatcgccgcgtactcgccctgcccggcccggtgaccacggcgatcatgcccgacacgccccacgccgccgagttcgcccgcgaagcccatcgcgccggcaagatcgtcatcctgcacatgcccatggacccggctaccgggcccttcgcctggcaccccgagctgcccatcgaagagctggaaaagcgcctcaacgccgccttcaaggccgtgccctacaccagcggcatcaacaaccacatgggcagccgcatgacctcccagccccaggccatggcctggctgatgggcgaattgcagcgccgccacaagttctttgtcgacagccgcaccagcgccaagaccgtggccgccgccgaggcgcagaagatcggcctggccagcgtgtcccgcgatgtgttcctcgacgacgaacgcaccgaagcggcgattggcacccagctgcagaccgcgatcaacctggcgcgcaagcagggttcggcggtggtgatcggccatccctacccgcagaccctggcggtgctcgaacgcgaactgcccaggctcaaggcccagggcatcgactggatcgatatcaagttgatgatcagcgtgcgcagcaacaaggccatggccgggcacggcaaggacggggtttaccgctgacgccaacatgccctgtagccgctgccgcaggctgcgatcgggcgcgcagcggccgctaatgcagccagcacctgggtggcatggaatacggctgcgccgtcgatcgcagcctgcggcagcggctacaggaggcggtcagaggtagcgccccatgatctcttccaccacgccttcctcacgcagttgatccagcgcggcctgtagccgggcgacggtctcgtccgggacctctttgttcagcgccaggtacagctgggcgctgtggaagcgcagcacggtcttgagcccggtcacgccttcctgcctggccagatagcgcccggcgggatcgccagtggcccataggtcgatctggccgccgaccagcttcctggcgttgtcctggtccctcagcaccaccagcggcttgagtccttgcttggccagggtctcggcaatggcgtcgcccttgtaggcgccaatccggtatttgcgtgcctgctccagggattgcagggcgattttgctatcgccccgggccagcatgatccagtcatccgggccgatggggccgacccatttgaacagcggctcccggtccggcagccgcgccatgacaaacacgccgtaccccggctgctccagggcgagcttgtagatgcgctcccagggaaaacgcagggtcaggctgtaattgatcccggcacgcttgaacatttcgcggacgatatccacagcgatgccgttgatattctcgccctgggcaaagttcttgccgttcttggccatgttgtagggggggaaattttccgtcagcagcaccagggaggtgcctggcgtttgcgctgcgcgagcgcctgcggcgaagaggaccgaagcgctgacaagaacaagaagaagacgtttgaacatgacgggctaccggaatccatggcgtgcccaagagtgccgcgagcccgccatgctgtccagtggctaccgcacgacgatgccgcggtgcgccatataagccttggcttccggaaccgtgtattcgccgaagtggaagatactcgccgccagcaccgcgctggcgtggccttcaaggatgccatcggccaggtgctgcaggttgccgaccccgcccgaggcgatcaccggaatgcccagcgcatcgctgatggcgcgggtcacacccaggtcgaagccgttcttcatgccgtcctggtccatgctggtcagcaggatttcgccggcgcccaggccttccatcttcttcgcccactccaccgcgtccagcccggtaggcttgcgcccgccgtgggtgaagatctcccagcgcggggtttcgcccggtccggacaccttcttcgcgtcgatggcgacgacgatacactgcgagccgaaatgctgcgccgcttcgccgacgaactcggggttgaacaccgccgcggtgttgatcgagaccttgtccgccccggcgttgagcaggttgcggatgtcctgcacggtacgcacgccaccgcccacggtcagcgggatgaacacctggctggccatgcgctcgacggtgtgcagcgtggtgtcgcggccatcgacgctggcggtgatgtcgagaaaggtaatctcgtccgcgccctgctcgtcgtagcgacgggcgatttccaccgggtcgccggcatcgcggatgttctcgaacttgacgcccttgaccacccggccgttgtccacgtccaggcaagggatgatgcgtttagccagcgccatggtgagtcctcagccttggtacgaatcgcagaaggcttgcgcctcggcgacgtcgagggtgccttcgtagatcgcgcggccggtgatggcgccgatgatccccggagccttggcatccagcagggccttgatgtcgcccaggttgtggataccgccggaagcgatcaccgggatcctggtggcagcggccagggccgcggtgaagggtacgttgcagccctgcatcatgccgtctttggcgatgtcggtataaacgatggcggacacgccgtcggcttcgaagcgcttggccaggtcgatgacctgcacgctgctgacctcggcccagccgtcggtggcgacgaaaccgtccttggcgtccaggccgacgatcactttgcccgggaaggcgcggcaggcttgcgcaacgaactccggctctttcaccgccttggtgccgatgatcacgtagctcacgccagccttgacgtagtgctcgatggtttccagcgagcggatgccgccaccgatctggatcggcaggttcggatagcgcttggcgatggcggtgaccacttcaccgttgaccggctggccttcgaaggcgccgttcaggtcgaccagatgcagacggcggcagccgccctccacccacttggcagccatgctcaccgggtcatcggagaacaccgtggaatcttccatgcggccctggcgcagacgtacacaggcaccgtctttgagatcgatagcggggataatcagcatctggcaaaaccttcaaattcgattgttcagcttcactcgaaaatcagtttttctcgagcgcccacaggtcgctttcgatgctttcgaaccgctctttgagctgggcctgcacatcgaaaatcgccctgttgtaatagtgcggagcaatttcgcgggtaaacagttcaagaatctcggccgcctcgaacgagcccaggtcgagctcgaagcgatcttccatgaagcgctggatcttgtgattggcctcactctcctgctcgggcgtgagggtcaggatcggcgccttcttcttgaccgccatttaccagcgaccgtcccacgccgcgaagttctgcagcaattgcaggccatgggtatggcttttctccgggtggaactgcacggcgaagcgcgagccctcggccagtgccgcggcgaaatcgacgccgtagtggccgctacctaccacttgccgcgcgttgccggcggcgatgtagtagctgtgcacgaagtagaagcgcgccaggtccgggatgttgtgccacagcgggtggctcaccgcctgtttcacttcgttccagcccatgtgcgggactttcaggtgctcgccgtcctcatgcaggcccttgccgaagaacttcacctggccggggaaaaggccgatgcagtcgacaccgtcgttctcttcgctgcggtcgagcaaggcttgcatgcccacgcagatgccgaggaacggacggtcctggctgacttcacgcaccagcgcgtcgaagcccaggcgacggatctccgccatgcagtcgcgaatcgcgccgacgccggggaataccacccggtcggcttcgcgaatcacatcggcatcgctggtgatcagcaccttgccggcgccaacgtgctcgagggccttggccaccgagtgcaggttgcccatgccgtaatcgataaccgcgaccgtctgcattacagaacgcccttggtcgaaggcatctgcccggccatgcggtcatccagctccacggccatgcgcagcgcgcggccgaaagccttgaacacggtttcgatctggtggtgggtgttgtgcccacgcaggttgtcgatgtgcagggtgacgttggcgtggttgacgaagccctggaagaattcctggaacaggtcgacatcgaagccgcccacggtggcgcgggtgtaaggcacatgcatctgcaggccagggcggccggagaagtcgatcaccacgcgcgacagcgcttcatcgagcggcacgtaggcgtggccgtagcgacggatgcccttcttgtcgccgatggctttggtgaaggcctgacccagggtgataccgacatcctccacggtgtggtggtcgtcgatatgcaagtcgcctttgctttcgatatccaggtcgatcagcccgtgacgggcgatctggtccagcatgtgctcaaggaagggaaccccgatatcgaatcgggcctttccggtgccatccaggttgatcgaggctttgatctgggtttccagagtgtcgcgctcgacggacgccttacgttcggccatcaccagctccgcaaaatcattgggcgaaaaaggcgaacattataggccggacggcggctaaacaggaacacgcaggacaagatcctgacgggcgcaacccaataaagccggggctgtacctgtcatgacaagtaaccaccccgttttctgtaggagcgagcttgctcgcgaaaaatccccagacaacgcgctcagacagaaagaacgcggtgcctggcagaactgatcgcgagcaagctcgctcctaccacaagcgctgcttagtggaacaacaccgcggtcttctgcagggtgacccacacgccccacgccagcggaatacccaccaccagccaggcggcgaccgccagcggcacgctgccggacgaggccttccactccagcacggtggtgctgtccgcgcccttgtcatggcccagcgcctgttcggcggccagctcggcgtcagtcatgaagtacttgtcggccaccggacgcaccagcaggttgcacaggaaacccagcaccagcaggccggcgaggatgtacagggtgatgtcgtaggccgcggcgcgctcgacgccgatgctcaactgatactcacgcagatagttcaccagcaccggaccaagcacgcccgccgccgcccaggcggtcagcagacgaccgtggatcgcgcccaccatctgggtgccgaacaggtccgccaggtaggccggaaccgtggcgaaaccgccgccgtacatcgacaggatgatgcagaacgccgccacgaacagcgcgacgttgcccaggtgcccgaggttcgggatcagcgcatacagggcaaaacccagggcgaagaacacgaagtaggtgttcttgcgtcccaggtagtcggagaacgacgcccagaagaaacgaccaccgatgttgaacaggctcagcaggccggtgaagccggcggcgatcgcggcgatcgacgccagttgcgaggcatccagctgaccgaaggccagttcattgcccagcagcttgccggcgaagacttcctgcaacagcggcgaagccatgccgaggatgccgatacccgcggaaacgttcaggcacagcaccagccataccaggcggaactgcggggttttccaggccacgttcacatgcacgtgacggtgggtgatcatcgcgttcgcggcttttttcgccggcggggtccaaccctcaggcttccagccggtcggcggcacgcggtacgacagcgcaccaccgatcatgaacacgaagtagatcgccgccatcaccaggaagctctgccagacgccgacgccggttggcgaagcgaagtggctcatcagtgccgccgccagtggcgcaccgaccatcgcgccaccgccgaagcccatgatcgccatgccagtggccatgccgcgcttgtccgggaaccatttgatcagggtcgacaccggcgagatgtagcccaggcccaggccgataccgccgatcacgccggagccgagccacatcagccagatctggtgggtatagatacccagcgccgaaatcagcaggccgccgcaccagcacagcgccgacaccacaccggccttgcgcgggccggcgtgttccagccagccgccccagatcgccgcggagcagccgaggaagatgaagaacagggtgtagatccagccgagcatcgagatcggccagtcgcactgggacgaaaagacctgcgcgataaagcccatgtccggggcgcaagccaccggagcggtcacgcccagggccttggacagcggcaaccagaacaccgagaagccgtaggccatgccgatgcacagatggatggccagagcggccggtggaaccagccaacggttgaaaccgggcttggcgatgatgcgttctttggacaagaacgccggctggacggcaatcgcgcccgcctcggtgctagtgctcatgagtgtttcccccaattattggaattattcgccggccactcttcactcacgacctttgcacgcagacgtggtcgttttatcgagtgaagctccatagagtgcgacttttggtcgcggaagggcagatgaacggcgaaagattaccatttgctcgtgacagaaaaagcaaactgccatcaccttttctgcgtcatctgtaccggaagacagcaatagcgcgctcctacagaagcgcgcggccccgccgacgacgcttgccccctcgccagcccatgcgctgctgtcgataatggccagctattccttcgctctgcacaggattccccatgcccatcgttgtcgagtcgctgaaagaaatcagctatcaggatcagcaggacctgcagaagatctaccgcgacgccccgccctggttgttcgcgccgcagcgcgacgatatggaactgatcgaggccgccctgggcgacggcagcctcatcgccgggcgcttcaacgaccgcctgctgggcgccgcccgcctgcaacggcaccaaggcgtctggcacctgtcccaaatgtgtgtgcgcaagatcacccggcgtcgcggcgtggccgagcgactggtgagcgaagcccggacaatggccgcccggcacggcgccaccttgcgcctgctggcccccgccgggcacctcgaagcccaggccctggcggccaagctgcagataccgctggatgtgctgcaaagcgatcagtgaccagtggccaggtccggggcgttatactccccggctaaattcgaattcgacactacaaggactcgcccatgaaagcgttcggcaaaatcctgggtctggtacttctcgggctgttgctgatcatcgtggctctcggcttcgccctgactcacctgtttgatcccaacgactacaaagaagaaattcgccagatagcccgcgacaaggcccacatcgagctgacgctcaatggcgatatcggctggagcctgttcccctggctcggcctcgaactgcatgaggccggcgtcgccaccctggccaacccgacccagccgttcgccgatttgcagatgctcggtttgtcggtccgcgtgctgccgctgctgcgccgcgaagtgcagatgagcgatgtgcgtgtcgaaggcctgaacctgcgcctgactcgcaacaaggatggccacggcaactgggaagacatcggcaaggtcgcccccgccgacaagcaggccgcaaccccggccaccagcaccggcgaaaccacaaccacgaccccggccaccacggaaaaaccggcgcagccgatccgcctggatatcgacagcctgaccgtgaacaacgcccgggtggaatacaacgacgaacagagcggcaagcagttcaccgccgaaagcatccagctgagcaccggcccgatccacgaagcgaccaataccccggtcaagctcaccgccttcctcgccagcacccagccggccgtgcgcgtgcgcaccgagttgaagggcgagctgcgcttcgaccgcgtcctcaagcgctaccagttcgaagacatgaagctgtccggcgaagccgccggcgatccgctgcaaggcaagaccctgaccttcgccgcccaaggccagctgctgctggacaaggccgccaacgtcgccgaatggaacagcctgaagctctcgctcaaccagctgcgcgccatcggcgagctcaaggtcaatgacctggacaagaccccgcagctcaacggcggcatctccatcgcccagttcgacctggccaagttcgtcgacagtatcggccagaccctgccggccatggccgaaggcagcctgagcaaggtcgagctggtcagccgcctgtccgccacgccgaacagcatcgccctggaaaacatcaacctgaaactcgacgacagcagcttcagcggccgcctggcggtcgaagacctggccaagcaatcgctgcgcgcccagctcaaggccgacaccttcgacgtcgaccgctacctgccgccgaaatccgccgaagccaacagcgccgcggtggcgcgcaaggccgaagtacagagcagcgaagccagcgccgtcgccggggccggcaactcgccgctgccggacgcgccgaccaagggcgcctggagcaccgagcgcctgctgccggtggaacgcctgagcaagctggatgtggacgccgacctgagcttcggccagttgaccctggacaagctgccgatccagaacgccacgctcaaggccaacggccagggcggcctgctgaaactcgagggcctgcgcggcgagctgtacaacggcagcttcgaagccaacggcaacctcgatgtgcgccagccaacgccgcagttgagcctgcagaccaggatcaaccgggtaccggtggaacgcatcctggaaagccaggggcagaccccgccggtcaagggcctggtgaccctcgacagcaacctgaccagcagcggcaacagccagaaggcgctggtcgacggcctcaacggcaacgccagcttcgtcgtcaacaacggagtgctgctcaatgccaacctcgaacagcaagtgtgccagggcatcgccacgctgaaccgcaagaccttgagcagcgagccgcggggcaaggacacacccttccaggaactcaagggcaacctgaccctgcgcaacggcgtggccagcaacccggacctgaaagtgcgcatcccgggcatgagcgtcaaaggcaatggcgacatcgacctgcgcgtactgggcatggattaccgtgtcggcatcgtcgtcgaaggcgacaagagcgacatgccggacccggcctgccaggtcggcgaacgttttgtcggcatcgaactgccgctgcgctgccgcggcccgctggaactgggcgccaaggcctgccgcctggaccgcgacggtctcggccaggtcgcggccaagctggccggcgatcgcctcagcgaaaaactcgatgagaagctgggcgacaaggtcagcccggaactgaaaaacgcactcaaagggctgttcaaacgatgagggccgagcagttcgcaccggcggtactggactggtacgaccgccatggccgccatgacctgccctggcagcaagagatcaatccgtatcgggtatgggtctcggaaatcatgttgcagcagacccaggtcagcaccgtgctcaactacttcgaccggttcatggcctcgctgccgacggtccaggccctggccgccgcgccggaagacgaagtgctgcacctgtggaccggcctgggttactacacccgcgcgcgcaacctgcaaaagaccgcgaagatcgtggtcgccgagtacggcggcgagtttccccgcgacgtggaaaaactcaccgagctgccgggcatcggcctgtccaccgccggcgccatcgccagcatcagcatgggcctgcgcgcgccgatcctcgacggtaacgtcaagcgggtgctggcgcgctttaccgcgcaggagggctacccgggcgaacccaaggtggccaagcagctatgggccgcggccgagcgcttcaccccgcagacccgggtgaaccattacacccaggcgatgatggacctgggcgccaccctctgcacccggagcaaacccagctgcctgctgtgccccctggaaagaggctgcgaagcgcacatgctgggcctggaaacccgctacccgattcccaagccacgcaagacggtcccgcagaaacgcacgctgatgccgatgctggccaaccacgaaggcgccatcctgctgtaccgccgaccttccaccggcctgtggggcggtttgtggagcctgccggagctggacgatctggcggacctggaacacctggcttcgcagcactcgctggagctgggcaagcaacaggaaatgcccgggctggtgcacaccttcagtcacttccagctggccatcgagccttggctcgtgcaggtccaggcatccacccatcacgtggccgaggccgactggctctggtataacctcgccaccccgccgcgcctgggccttgccgccccggtgaaaaagctgctcaaacgcgcggccgacgtattgaacgcaggagagttgcaatgacccgcaccgtaatgtgccgcaagtacaaagaacaattgccgggcctggagcgtcctccgtacccgggcgccaagggccaggagattttcgagcacgtgtccgccaaggcctgggccgactggcagaaacaccagaccctgctgatcaacgaaaagcgcctgaacatgatgaacgccgaagaccgcaaatacctgcagggcgagatggacaagttcttctccggcgaggaatacgccaaggccgacggctacgtgccgccgtccgagtaattgcactcaaatcggggcgggaacgtaagcggcggtaataattaaactttttttcaaaacttgcttgacgcccccccgaaaaacccgtttaatgcgccccgttgcccagatagctcagtcggtagagcaggggattgaaaatccccgtgtcggcggttcgattccgtctctgggcaccactaataccgaaacccctgaatcgcaagattcaggggttttttattgcctgcgatttgacgtagattattttcactcctcagagatcgacctcatgctgccgcctaggctatttgagcgagtcatcggccaactccaggcgaaagagctacaaagcaaggttacagctcccatgcgacgcctggagacgatttagccgccaacatccccttgcatcgccttactctgcgcaacatccaacaacgccacgccatcgctcagcagcagcgaggcaatatccgctatttggaataaatcactttcgtcagccgtacgagcggtcatgcaagacaggctgctcatcagtttgtagatgacccgaacgcgctggtcggcgcagaccaataaatccatcagtgaggcgctggagtcgataagcaggacgtatccgttcattgatgtagctccgtgcgtaaaattgggctaccaccagactctcctacaagttgggtggcagctgtacgcggggtaggagaccggacgaacgacccgaccacgtctaagcgtgtccgcgcgcagccaaaaacacttgagcaatcggcacaggctgccaatcccagaaaaaaggtatagcattcggccatatggcagtttatcgaattggactcgagcgctatgaatctagacagaatcgtctccgtcatcagcttactaattggactttcaggtatcggactcagcatctatctcgctcagcctgaaagtaacgcaaatatagtttccctctcgggttggctagcttcgattgtagtaacgatagtcttaagcgtcagtgcttttttcaccatagggaatttacagaaagaaatagggtccctacagcaggaaattgtcagggcaaaagacgagtcaatccaacataaaaatgatttaatttcccaacagaccgatcttgtttcctaccgaaatatatcatccactctctcatcaataattaacccagagcctttaaaagataccatacgcaacaaattagctgcatttatgggcaccccccaagagcaaaaggacgagcaaaaatgaacttcaaggaccaattgtacttccctataattcgtacaagacaggccgaactcaacggctatgcccgcctcagcgatgagaccaaagacaatctatgccctcttattacgcttggaaagtggagaaactccgaagattgcgataaggcaattgcaaaaatatctgagtgcgtgggcaacagaaattatattttagatttgactcgcgatctgcaacatcagaatcaagctgttcgagaactgatgaatccagagtcaaacttcagcaactgggtagagtttgtaagaaacaatgaaaacatcattccaactgtacagcttacccaaggcgccaaagggcgtgagattgtacgacaagccgtagctcttgagaacctatcacgcccccctgtttttagaatcaaggatttcaagagcgacctcgacaacactctcagcgccttgtacgcactcgacaaccctgagaacgccctgataattattgatgccggatatatcagagacatctcaacaaagaacataaagcctggagttttagaaagcattctgcggacgataaataggattgttgatgagatccctgaagtacctagggttcttgcaggaactagcttcccccgctcagtgacaccttggctgaatgaagaaagcgaaaagtctggaaagatagacatacttgaaaatattctttttgatgaaataggctcagacatcgtaatgtatggcgaccacgtatccatccattcggtagtttatgatgatgaaggtggaaccttcctcccgcgcctagacgtcccaagcgatggcttctggcatttcgaacgcagaccaaaaaccaagagtgagggctatatcgatgcagcaaatacactcttggaaaatcaccccgaattccaagaaagtaatacttggggcgccgaaatgctcagaaatacagccaacgcatcagggacgacaattaatgctccagtaactgctatcgcagttcgagtcaaccttcacattgattatcaaataaaactactaagtgatgctcctcaattagtagaggatgacaactggattttctagagcactgggacaagtacatggcgcggaatggtgtcaggaatattcccatcaggaaaaaacctggagagatttatttctctaggtcttcccgaagagggacgaggtttattccagtcaaattctttctctagctgtcgcctttttgctttggatcggctcaatctttctagatcgcccaaaacaacaacatcagagcactgcgagagaaagctcgagctcaactccctatagcgagctttaacacaagcaattgcctcttttctaatgctactcacagacgccagagcacacagttcaatcagccgctcccgatccgccaccttataatcaaccagaattcttcgcgaccgtagaaagtttacgagctcgctcttcagcataaaatcacatactgcatcagggttagatattgattgaattcgccccgctctcctaacccgtatcaccactttatcttttactgaaaccgcttcccaaacaccgactctctcatcagattctagagcctgcctaacatagcgtgaagagaccacaagcgttaacttatcaaatctagagagatagtcattaatctgtccagacaaccttctcaaggtatcaaagtcgctcttgacttcaaacgcttgaatatggccattcaccaaaaccaagtccgcacgtctattaccgctaccgaaaaccatctcattaacaagaacagcatcctgcgctgttaagcgatcacgaattttctctaaggccgcagccttgatatcctgctcattcagttccttcttcataagcctagactctcaatttcaaaaaatacattcattacaaatacttcacgctgacgacttagtgagcaacctaactagcgtctaatagcttatcagctgaagtggtacaagggacgccccccgctgcacaaacagataactgggcattagcacgcctcaatccaaaataatagcttcaaattggtacacacagctaggagactagcttgcaaaccagacaacctaaccaactgattcttatgggcttagctacactttcgaacagactcaacagttcaatcccatctctgacaccactaatccccctgaatcgaaagactcagggggaattattactctgctgcgagcatcgtctccgcccttatcagacttgcattgccttgccctgcacagcatctagcagcgccacaccatcgctcagcagcagcgaggcaatatcagcgatctggaacagatcactttcatccgctgttttggcagtcatgcaggacaagctgaccatcagcttatggatggcacgcacacgctgatcagcgcaggccagcagatctaacagaggggcgttgctatcgatcagcaggacggggttgtcggtgggggtttgtagagagatgtatccgttcattgatgaagctccgtgtagatattaggaaccatcaccaagccttcctacaggccgggtggcagctgtacgcagggtaggaaccggctacacgatccggtcacgccaaagcgtgcctacgtacagccgccataacagacaggcggcgaaaagcggccgattctactcggaagctgtacgtatcgtaaggcgggttcctacacccggccgctgatttggcagcgaccgacacagggtaggcaggcctccccattcagcacaatcctcagtcagtgaccggacgtaacagcgatcagggagctgacagtacttatccccaaggcgttatcgactctagtaagacggaccggaaaaggcctgtaggaaccatctgatttattcgcccacaaagaattcaagccctctgctgacttgagcccgttagttgattgcgccaccatccgccccctgcttattcaatggatggatttcacggcatgctggatgctaacgctacccatatttccctgacgatcgaaggcgcctcggtcgaccttcaggtcctcagtttcgttggccgcgaagccctcaatcagcccttctgcttcgatatcgaactggtcagcgcgcgtcccgacctcaagctcgaagaactcctgcataaaccagcctgcctgaccttcggcagtacgggtaaaggcctgatccacggcctggtgtaccgcatcgcccagggcgattccgggcgcaagctgacccgctacagcatcagcctgactccgcagctcaactacctgcgccacaacttcaaccagaagatctaccagcacctcagcgtgccgaagatcatcgcccaggtcctcgaggcccgcggcatcctggccgacgcctacagtttccagctcggcgccacctacccggagcgggtctactgcacccagtacgacgaatccgacctgcacttcatccagcgcttgtgcgaggaagaaggcattcacttccacttccagcacagcgccagcggccacaagctggtgttcggcgacgaccagacagtgttccgcaagctggcggcggtgaactaccaacaggactcgggcatggccgccgaacagccggtgatcaagcgcttcaacctgcgcctggaaatccgcaccagccgcgtcagccgccgcgactacgacttcgagaaaccgcgcctgctgcccgagggcgcggccaagtccgaattcatgccggacctggaagactacgactaccccggcctgttcacccagcaggcccgcggcaagcaactggcgacccgcgccctggaacgccatcgcagcgattaccggctggccgaaggcaaaggcgacgagccgagcctggtcagcggccacttcctgaccctggccgcccacccgcgcagcgaatggaacgacctgtggctgctgctggaggtgatccacgaaggcaagcagccccaggtgctgggcgagaacatcaccagcgacgtcaccagcaacaaggacgacttccaccagggctaccgcaaccgcttcctcgccacgccctgggacgcccactaccgcccgccgctggaacacccgaaacccaagtccctgggcagccagaccgcgctggtcaccgggcccaagggcgaagaaatccattgcgaccaatacggccggatcaaggtgcagttccactgggaccgcgacggccaggccgacgacaacacttcctgctgggtccgcgttgccagcggctgggccggcaaggcctacggcggtatcgccatcccgcggatcggcatggaagtgctggtgaccttcctcgaaggcgaccctgaccagcccctggtcaccggctgcctgtaccacaaggaaaacctggtcccctacgacctgccggcgaacaagacccgcagtaccttcaagaccctcagctcgccgggcggcggtggctacaacgaactgcgcatcgaagacaagaaaggcgccgagcagatctacctgcacgcccaacgcgactgggacgagaacgtcgagcacgaccagcggatccgcgtcggcaaccagcgccacgacacggtcgaagccaacaccctcaccgaactcaaggccgaggaacaccgcatcacccacctcgaccgcaagagcgaaatccgcgccaacgaccacctgaccgtggccgtcacccagcacgccaagatcgggacggcgcagttcgtcgaggctggccaggagattcattacaaggccggtgggaaggtcgtggtcgaggcaggcgcggaactgacggccaaggccggcggcagctttgtgaagctcgatgctggtggcgtgaccatcagtggggccgaagtgaagatcaataccgggggagcgccgggggttgggacgccggcggcgccgctgttgccgggactgctgaagctcgctgacgccgacaaggccggcggcctgctgctgggtcgtttgaactcgcccataccgcgcctgacgccgcccaagggtatctgcgtggagtgctggaaaaaagcattgcgccagaagctggcattacaaacaggggagcccgcatgacctctctaacagcctctcaagcctgggctcaagcgcagtcaaatgcacaaccacgttatgccattgtcgaaacgggattgctgtctgacgaatcgcgcatgcgcttcctgaaatcggacttttcgcggtattccatcatgcgtcagaacgagttcgccgaattacgcgaatacggtccctggctcgtcgatgtcagccctcttacgttcgatgaattttctactcatgaattgttttcgaatcgccaagcgctcatgggctggatcagctccgattgtccgggcgaccagttgaacgagcatttgagtgacgcgttgctggcaaagaatgaagtcgaagaagtccttttgattcgcagctatgcccctgaggttttgcccctgcttcacgctcgcccagacctgccttggcatccctggctatttggcccgttgaaagactcaacgactggcaatgcttccagggcggcggcaacaaacagctgtcggagtatcatcccatcaccctcgacgcccagctttggcaggctttggagctggacccactggcctataaccttgtgagcgaactcgaacgttcggcgccggaagtatttaccagttcttgtcatggcgatcgtctgacacaagtagaaaaagccatcgacactggccgccaggaaggtcttgaaacaccggaagacatcagcctcttcgccaccttgaacctctttgatagggagtttccgagtaactggtccaaatggtcacaagcaaaaactttggttcgccaagaaaaactgccccttgggcttgtcatgaggcagttgtccgaatgacttccattcaagagttatcggaacaacagctggcaccgcgaaggactgacacttttttggacaggcctattttcagctaccgcctagcaagatctggagaagatcaaaaatgttaaaacttgacttgaactcaattaaaaacagtcaaccgcggcggcgcgcaaaaataattgcgggagcaataattttatcaatctccttggctttattatatttttatactcagcctcgtcttcctgctgcaatgataacttcggaaaactatacagatagacctatatttagtttttggattaatgatttctggggcggaaatcttgctgcaatggggggaggtggaataatttgctgtagcaacttcgagggttcaaccgcaaaagttgtgtggattctggacatgactaaaaaacaaaagctacagggcgcaatagaagagcgtcatgaaaaagagataactatgcctccacgtggaaaaagtgatcgctatttacacgtgcgttttgatcccgaacataatgtgcgcctaggttggagcccagatctatttagtccttttgagaaacggcctttatcgaaaaataccgacgagggccatggcaatgaataaaatacctaatcttgatcacgctcaggcaatatgctcatcggcaagcgctggagtgcagaacaaaaaaaacagcgttcttccatgctcagcaactttacatataggatttttctttgacggtttcggccacaatttagagcatgatatccagaacgatcagaccactaatatatcgcgcttattcatggtgcaccctgatgtggatctatctgatgctgccgacccatttgctctacatagacgcttttacatctctgggattggcacagatttcgacacgaaactcggtggaggtacagagctatctcttacaggattacaaggagccctgaataaggccaaggacaacgtggccgacgtccccaaaggcagtgccacagatgccgcagtagatgccggcaaggacattctgacgggtaaaaactggtgggaaaatctacttaacaatcttaagccgggaaatatcgtctctaccatagtcaaagccgtggctcctgccgccatcgaaatcttccctgccatccgcgataacgaaatagccgctgacttgttcaagaccggggtagacacacgtcttgaggcagcatctcaagcgtttgaagatgcaatcaccaaggcggaggcacaaagcaaggctcctatcaaacgcgttgctgtttctgtattcggttttgattttggagccacactggccagagcttttgcccacaaactctttgaagactgcgatccagggacaactcgcttcaagggtaaaaatcttgagatcgtcttcgcaggcttgttcgacgctgtagaccgaagcagtgaaagctcgatcattggggattttatttccccgttgaccagtaaggtggacgacggtgaatgccttccaggccccgtcaaagcagccctgcatttggtcgcagctcacgaatgtcgtagtacccgtcgctctcgtctcatcggcacaggctctctcactccgagatgggaagagcggctggtaccaggcacgagttacgacgtcggagggggcctaaaaaaagcagatgttccttacagcctggagctgcataaagcgaccctgcaagacatgtatcgagccgcgtatcgagcaggagtgcccttccctgagtttgagaagctgccggacatcggggtgaaaatctcacaactctttgaactcaatgatcatgtcaatggcatcagcgcaatcgaatcctccaagcgttatatggccaaggtagggcacaaccaagtttccgccgagtccttcctgacacaccgctgcatgtatatccgccgtcttcgcagcttgtggcaactctataacggacaatatcgcgcctacagtgacgaggaagatcgcttggaacggccgatctttggcgagaatggttcattgaaaaaaatgctggggttaggtggcgaaagtgaagctcaggcgaaaaaacgtgactatgcactgaaacaggttcgcacccacaagactgcgcttcgtaatgagttgggatggttggaggcggtcgatgcagaagccagaagaataagaagcggactgtccactgaagctgaaaaagctctactgaacgaatggttcaatccaaacccgcccgccttgaatcccgacgtcgaagatttgctggagctttacctcaacgatagttacatgattggccagatgcccaaggagccgatgtacctcaaatatttccttgtacgcggcctcgacaggcctgacctgacgaaaactaaaggaatggcacctgattatttgcaacaatatatgagctgatcggcaacctgccttaatagctagaagcaacatcaatgcggtaacgcggacttcccatttcgtaagtaacaactaattattcgattccgtctctgggcaccactaataccgaaacccctgaatcgcaagattcaggggttttttcttgcctgcgatttgatgcgcctgttttcagcattgcagccttcactcaataactgtcattccagtgcaggttgaggtcgcgaatacccgccactttcatatccaccgtgttgcgctcggtatgtccgccacgggtggcgataacctggtacttgccggccggcagttgcacaaagacgatggggcccacctgattcagggtcaggaccggctgcccttgcgggttctggatcgccaggtcgacatccgaggtgtatttgttttccgggccgacggaaaaggtcatgtgcaggttgtaccccttggtttgcaagagcgcccgcgattcgtccaggccgataccgccggacagataggtaatgccgttctgctgttgaggttccagctgcacgcccgccgggtcgatgggttcgttgctgggggtggcggactgtacgctgaacggcgcgagtgacaggaacgccgcgagaacgcctgttacgacacacaagtaaaaggacttcatgatgagcactcccgggttcgtctcgaaccactgaatgggaacgccaccgccaagagcccagccccagaacggcggcgtccgggtctccccttttcatcttgaatggtccagctacgcctcaggcaaacgatgctcgaatgaacagcccgtgagcgtcatgcatccgtgatcgcccccaggccctgatattcagtgtacgccccgatgccaggccgtttagatcgattcggtgtgaggcttttaaccaaaagtacctagcagcggcgccaatcccgacggttgccacggcgcggacaaggcggttattaatgcttgcacctaaaaagagccgacacaccttttcgcccgcaaaggaatacgcgccgatgaccgtgcaatccccgccctcgcccctgcacccggccagcaccgcgaccagcagccctggcacggcgtttcgcgagcccgccgccgatggctttatcctgggcggtttcacctggcgccatgccgaaccggaccccgcgcgtgcggtggtgatcatcaatgccgccacctccgtgcgttgccggcactattcgcggttcgccgattacctgttcagccatggcttcgacgtcatcacctacgactaccgcggcatcggcgagtcgcggccggcctcgatgcgcaagctgaaggcgtcctggtcggactggggcagcctggacttcgaagccatgctgcaacgcgcgcagcgggaatccccggccagcccatcgacgtggtcgggcacagcttcggcggctgcgcggcggggctgggcgcatccgggcagttgatccgccgcgtggtgacagtgggcgcgcagttcgcctactggcgcgactacgccccggcgagccgctggcgcatgctgggcaaatggcatgtcgtgatgccgctgctgacggcgatttacggctacttccccggcaagcgcctgggctggctggaggacacccccgccggcgtggtgcgcgactgggtcacgcccaccgcgcactatcaacggcggcccagcgggcgccacctggcgcgccgggatccggcgctgcccttcgcccgggtcaaggcacagctgctggccatcagcatcagcgacgacccttacggcaccgtgccggccatcgagcgcctgctgggctacttcaccgccagccagcgcagccattggcgcatcgaacctgcggacatcggcgagcaggaagtcgggcacttcgcgtttttccgtagccattaccaggaccgcctgtggccgatcgccctggcctggctgcaacacgccacattgcccagcgacactccgggacgcctgatcagcggtagccgttgagcgtgccaggcagcgcatttactggcatcctctgccgcctgaaagccaggccggacactgtatccatccctggccccctctttgcgcaaaaggtacgacgcccatggcatctgcgaacaagcaacataaaagagcccagcgggcgaaaaccaaggccaagcagaaccgcacccagcgtaacgccgcgccagtggaactggacccgaacgacgaccgcatcgacttcgaatcggtggacctgaccgagctgttcaagaagatgatcgacgccgagaagatcagccagcaggcgatgtgcgcggcgttcctggaggacccgctgctggagatcgtctacgagcaggaaggcgaggaaggcgccatggacttcatcctcgccgcgctgatcgagtaccgccagtggtccaccgagaccgacgaggccggcgccctggcctggatcgaaagtccagagttccaggccgcttacctggccgcttcggaagcactgatgcagaaataagcttcaacacgatctgtagccgctggcgcagcctgcgatcagcttgggtggcgctccgacgaagcggccgtctgcggtgggtcagccgttacccgtttgccggggttgcggccggtgcccggccgatcgcagccttcggcagcggctacagcgcgtcatgcatggccctcactgccgtgttgaatattcaatcgccatcgcgagcaaggatcaccttcatctgtaggagcgaggcttgcccgcgaaagcgtcggtacaggccataaaaaaggccgctgtcagcactgacagcggcctttttcgttaccgggaaagactcaggcgcggctcaatacaccggccgcctgcttctccagcttgcgccgacgcgcaaccagcaggcccgccgcgatcacgaccatgctcagcaggccggtggcgacgatctccatacggtgcccttcctggaacagcatgatggtcagcaccccgacgatgaacacgatcaccgcgtaggtcaggcctgggaacagccacatgcggaaggcgatcttctcgccggccgctgtgcgtttctggcgcatgcgcagctgcgacaccgcgatcaccaggtagaccagcaaggcgatggcgccggaactggccaacaggaattcgaacaccgcggcgggtgccacgtagttggcgaataccgcgaggaaggcggccgcggtggataggatcaccgcccagtaaggcgtgccgctagtgttggtgcgcttggccgcggccggggcatcgccgcgcttgcccagggagaacagcatgcgcgaggcggtgtagagcgccgagttcaggcagctggtcaccgccaccagcaccaccagatcgacgatcagcttggcgttggggatgcccatgcggtcgagcacggtctggtaggaaccgacctgggccaggctcgggtcattccatggcaccagggccacgacgatgaagatcgataccaggtagaacaggccgatccgccagatcaccgagttggtggccttgctgatctgctggcccgggttcttcgattcggcggcggcgatggtgacgatctcggtgcccatgaacgagaacatggtggtcagcatggcggcgagtaccgcgcccatgccgttgggcaaaaagccctgggtatcgaacaggtgcgagacgccgctgacattgctggtcggcagcaggccgaagatcgccagcaggccgagcaccacgaagccgatgatcgccacgaccttgatcagggcgaaccagaactcgaactcaccgtagttcttcacgctgaacaggttggtcgcggtcagcagcaaggtgatgaccagggtaaaggcccagatcgctatatcagggaaccaggcatgcaggatggtcgcagcggcgttggcctccagcggaatcaccagcacccagaaccaccagtacaaccagccgatggtgaaaccggcccaatggccgatggcgcggtcggcataagtcgagaaggagcccgtatccggcgaggcgacggccatttcggccagcatgcgcatcaccagcaccaccagggtgcccgccgccgcataggccagcagcacggcagggccggcttcggcgatggcgtggccggaaccgacgaacagcccggcaccgattaccccggcgatcgacagcatggtgacatgccgcggtttgagcccctgttcgaggtcattggaggtctgcgtactgctcattgaaactacctttgcgaagaaagcgaaagcgtccacccggcctggatattctttctcgtaaaaagaatccaacagggcgttctttatttcttacgcaagatttgcgccaaaatgttacaggctcccagcgggcgcggcctgtgaaggcgaccggcggatgagcgcaagtccttgagattaatggccttgcgccagaacgttaccgcaccacccatttgtagaacgaagcagcgcaccagaaacacacacaaaaagtgtgcgacgcacaaatagagggcggatacgcaacctttggccgttttacccttccaacacctggccaaagctggcaccatcgcgcctttttttacgcgacacccgctgggaacagggttcaaacgggcgttcggttgttgacggggcgacagtctgctgtgccgatgcgacaacctgtcacacgccgtctgcttacaccctgaagcgctgttggctgtcattcgaacgctatgctaggttggcgcctcgccagaaaagccgctaccagcaggagcgcaatgaactcatgaggaccgcacatggctgaggccacgcccgcgcttgaaatccgcaacttgcacaaacggtacggctcgctggaggtactcaagggtgtctcgctgaccgcgcgcgacggcgatgtgatctcgatcctgggttcctccggttccggcaagtccaccttcctgcgttgcatcaacctcctggaaaacccgcaccagggccagatcctggtggccggtgaagaactcaagctcaaggccgccaagaacggcgaactggttgccgccgacggcaagcagatcaatcgcctgcgcagcgaaatcggcttcgtgttccagaacttcaacctctggccgcacatgagcgtgctcgataacatcatcgaggcgccgcgccgggtgcttggccagagcaaggccgaagccatcgaagtggccgaagcgctgctggccaaggtcggtatcgccgacaagcgccacgcctacccggcccagctctccggcggccagcaacaacgcgccgccatcgcccgcaccctggcgatgcagcccaaagtcatcctgttcgacgagccgacctcggcactggacccagaaatggtccaggaagtgctcaacgtgatccgcgccctggccgaagaaggccggaccatgctgctggtcacccacgaaatgggctttgcccgtcaggtctccagtgaagtggtgttcctgcaccagggcctggtggaagagcaaggatcgccacagcaggtgttcgagaacccgctttcggcacgctgcaaacaattcatgtccagcaaccgctaacggagcaacacgcatgcagagctataagaaattcctcctggccgctgccgccactctggtgttctcggccaatgcgatggccgccgacaaactgaagatgggcatcgaagcggcctacccgccgttcaacaacaaggatgccagcggccaggtcgtcggtttcgacaaagacatcggcgacgccctgtgcgccaagatgaaagtcgagtgcgaagtggtcacctccgactgggacggcatcatcccggccctgaacgcgaagaagttcgacttcctgatctcctcgatgtcgatcaccgacgagcgcaagcaggcggtggacttcaccgacccgtactactccaacaagctgcagttcatcgcgcctaaagacaagaccgacttcaagaccgacaaggcttccctcaagggcaagatcatcggtgcgcagcgcgccaccctggccggcacctggctggaggacaacctgggcgacgacatcaccatcaagctctacgacacccaggaaaacgccttcctcgacctgacgtccggccgcctggacgcgatcctggccgacaagtacgtcaactacgagtggctcaaaagcgaagcgggcaagccttacgagttcaagggcgacccggttgaagaaagcgacaagatcggcatcgccgtgcgcaagaacgatccgatccgcgagaagctcaacgccgccctgaaggaaatcgtggccgacggcacctacaagaagatcaacgacaagtacttcccgttcagcatctactgatactgactggcctgcccggcgcccttccccgagggcgccggtccttagcaaagcctgccgcgacttgaataaccatccatgaatatcgatctctacggattcggcccggcgctcgccgctggcgcgctgatgaccgtcaagctggctctttcggcgctgtgcctggggctggtgctcggcctgcttggcgccttggccaagacttccccgtacaagccgttgcaatggcttggcggcacctattcgaccctggtgcgcggcgttcccgaactgctctgggtgctgctgatctacttcggcaccgtcaacctgatgcgcgccctgggtgagttcttcggcaacccggagctggaactcaatgccttcgccgccggggtcatcgccctcggcctgtgcttcggcgcctacgccaccgaagtgttccgtggcgcgatcctcgccattcccaagggccatcgtgaggccggcgtggccctgggcctgtcgaaatggcggatcttcaccaggctgatcatgccgcagatgtggcgcatcgccctgccgggcctgggcaacctgttcatgatcctgatgaaggacaccgcgctggtgtcggtgatcggcctggaagaaatcatgcgtcactcgcagatcgccgtgaccgtgtccaagcaacctttcaccttctatatggtggcggccttcatgtacctgggcctgaccgtgctggccatgaccggcatgcacttcctggaaaaacgcgccgcccgcggcttcgcgaggagcgcccaatgaactgggaagtgatcatcaagtggctgcccaagctggcccagggcgccacgctgaccctggagctggtggccatcgcggtcatcgccggcctgctgctggccattccgctgggcatcgcccgctcatcgcgcctgtggtacgtgcgcgccctgccctatgcctacattttcttcttccgcggcacgccgcttctggtgcaactgttcctggtctactacggcctggcgcagttcgacgcagtgcgtaacagcgcaatgtggccgtacctgcgcgatccgttctggtgcgccaccgccaccatgaccctgcacaccgcggcctatatcgccgagatcctgcgcggggcgatccaggccatcccgccgggcgagatcgaagcggcgcgggcgctgggcatgtccaagcccaaggcgctgttctacatcatcctgccccgggcggcgcgcatcggcctgccggcctacagcaacgaagtgatcctgatgctcaaggccagcgccctggccagcaccgtgaccctgctggaactgactggcatggcccgcaccatcattgcccgcacctacctgccggtggagattttcttcgccgccggggtgttctacctgctgatgtcctatgtgctggtgcaaggcttcaagctgctggaacgctggctgcgcgtcgagcagtgccaaggccgctgaaccgttcgctcctaccggcgccccgttaacctgtaggagcgagcttgctcgcgatccgcgtagcggccatcccatgcggtgttttgggggacgctatcgcgagcaagctcgctcctacagttgctccacaccctgccgagcctcccagcatgcccatcctccaaggccccgaactcctcagccgcttccaggccctggaccgcttcctgctggaccatcaaccgctctggcgcccacgccccttcaccgagccgcagctgccctgggaagcccgacaccgcgaactcgcccagtggctgcgccagcgcagcctggacgatgccgaggcgagccataaccacccagaacggctcgatgctcccgcacccttccccgatctggcgcggaccgccgccgcgctcggcgccgtggccgagttgccgatgcacgaggtgccagccgcccgccagcgcctcaacgtcgatgtgcccgggcgcaaatggcagcagatcgaagccttcgccgcctgcctggagttcacccgggcacccggccactggctggactggtgctcgggcaagggccatctcggccgtcgactgctgcaacccgggcaacagctgacttgcctggaatacgacccggcactggtcgccagcggcaggcaactgagcgaacaccatcggctagcggccagccacctgcagcaggacgtactcgccgtcgacgccgctgcccgactgagcgccgaacacaccccggtggccctgcacgcctgtggcgacctgcatgtacgcctgatgcaactggccagcgaacgcggctgccgccagctggctatcgcgccctgctgctataaccgcatcagccatgccgagtaccagccgctctccggcccggccaagggctcggcgctgcaactgtccctcgacgacctgggcctgcccctgagcgagaccgtcaccgccggcgcccgggtgcgccgccaacgcgacagctccatggcccgccgcctggccttcgacctgctgcaacgccggctgcgcggggtcgacgagtacctgcccagcccgtcgctgcccgccagttggctggacaaacccttcgccgactactgccgcgacctggcggccctcaaggacttacccacagtcggttcgcaggactggccggcgctggaagccgccggctggcagcgcctggcccaggtccgcaacctggagctgctgcgcggcctgtttcgccggcccttggagctgtggctggtgctcgatcgcgggctgtttttgcaggaacagggttaccgcgtgcaactgggcctgttctgcccggcaccactcaccccacgcaacctgatgctgctggcggaacgtggataagttggatccatcgtcctatccatcctgtggataactctgttgatgaaatcccgccaaagccgctgaaagcgcctgctacagcctcaatacagagctggtcattttttgttcataaaaataaatcagcgaaaaaacagccagttgcggcgagttgagaacggatccacaaaatcagcgaaaacagccacgcgacagccatcgattgtgcataagcgtcaatgccaaaggacataacagccgaaaaccggcaccacaggcgaggcaaattgcgccggtcggcgacgcttgttatacagacgcaggcgctcgcgggcgcccagaacctttgtgattgacgggaaaagacagtgacgttcatttcttatgcacaaaatttcgaagacatccgcctgtggcgcgcgctcaaacacgttgaaaacggcttctacattgacgtcggcgccaaccaccccactgccgactcggtgacccgcgccttctatgatcgcggctggcgcggcatcaacgtcgaaccggtgccgagctattaccacgccctgtgccaggagcggcccagggacaccaacctgcaatgcgccgccggcgacaatgccgaggccctgaccttctacggcatcgccgacaccggcctgtccaccctcgaccccgccatcgcccagcagcacaaggacgccggcatgccggtgcagacccagatcgtcagctcacgcaccctgagcgacatctgcgaggcccacgtcggcggccccatccacttcctcaagatcgacgtcgaaggccacgaagaaaccgtgctgcgcagcatggacttcaaccgctggcggccgtggatcctgctgatcgaaaccccgtggaaccgcgaccaggcctgggaaaccctggtcaccggcgcgggctaccacccggtggtgttcgacggcatcaacaccttctacctggccgaagaacacctgaacctcaagggcgccttcgacatcccgccgtgcaacctcgacgaattccagttcaaccccggccaccgcttcgtcgcccccgccaccgacctggaacaggccctcatcgccgaacgccaacgcgccgaccgcgccgaagctgcactgcacgccctgcgcaacagccgctcgtggcgcgccctcgaaaaactcaagaaagtgctggtccgcagctagagcccggcacaaagcaaaaatagtcagatttcaggggtttacagaacctcgccaatcgctataatcgtcgcccacacgccggtatagctcagttggtagagcaactgacttgtaatcagtaggtcccgggttcgactcctggtgccggcaccatacagatcaagggcttgcagcgatgcaggcccttgtcttatgtcccgcacgtaacaacagacgtaacaagccctccacgcgtacacgcatgcgcgcctcatacgctgggtttccggccaaggtatagggggggtctgcaaaaagagtaacttcagtaatcttgaccgacgaaccatcgcaagccgttgaaaaggctaggtttttcaggaacgggcaagagtaatctttaagtaaccttgaagtaatctgattactcttttaaaaggtgattttcttcattcataaaagccttataaatcaggcacttaaagaaaaattacttttttgattactccttggttactaccttttgtaatcagcaaagccccgtaaaacgcgggctccagccaagcctccccgctcgattactgaaattactctttttgcaaagccccccctatcccacctctggaagccatccaggaacaagccgtatttgccccttctgtgcagggattcgcagggaaaacaggtccaggtaaccccctacccggcccagtgcctgcaccgccggcatagctccgcaggggcgcagaaaaaacgacacatttagcccgccggcgtggcagggggacgagcgcgcgcgccaggttaaaagcagcacctggttaccgagtgatcgaagcgttggagttcggtcggcgcgtgccgtcgtcgcggacatcaggccagccgctggtgttcactatcgaggattttttgtagcagatgcagggccaccaaattgccgcccgtggtctcgcgccatgcctgatgagtggtcttgtacaactggtcgatttccgcgatcacctggcggtaacgtacaacttccaacaccaggcgccggacttcggggtgaggctgttgcaaccagagggcgcgcagttcggcgtgcgtgaccggccggaacggcggtgagttgcagggcatgacggacaccttaaactgtatgcatatccagtataatgatcgacatctgcccgtgcctattgccggtcgtctatataatcaccgccatgaatcctgaccacagaacctccccactgctaggctaaatagctcaaacccatggagggcgatctatgcaaatgcacgaaacccaacaggtcaaagaggtgtacagcccgcaagaggccaaccaactgctcaaacaggggtggatcctgttgacggtggtggccgtaaccaatcccaaggtgcagaacccggtgatcaccgtgccgtgctacatctttggccagaccgcctcggccccatgagggtctgcaaagcggcgaatgagccagaacggacacgatccgttcgccgcgtacaacatgccggctgcagtgcacggccaagcattgaaactgctagaccgcatcgcccaagacgaactatggcgcgcggcgttttgtgctggacctggaaacggtcaaggcgctgtatgtgacctcaacagcacggtcgcggagtggcgcgtggagcatgagcaatgaccggctatccagcctaacgatcgaaagcagggagggctggccatgcctacgctattcgatcaggtagcggtaagggctaaaagctgatatactgtatgtatacacagtattgaattgtcttgtctaagcaaaaatattgtgataacgggtacaaaagttattagtaatgcggatatactcgcgcgccgctcaataggtcaacagagcgagtaaggaggggcagaatgattacatccatgcagaaagcgattgaggtcgctaagcaagcgctccagattgcttggaatggcgccctacctgtcaaccctgaaattattgctaccagtttggttgtcttcaaaaaagacgaagccactgggatggacaaaaatatccctattcgcgttcgagcattaagtccttttgaccttgatgttagtggccaagcctctcttgttaacactccagagggaccggttttttattgcgattataatgaaagtgaaatcatttatcgtaatcgtttcactttggcgcacgaactgggccatgtcttacttggccatgtaaacgaatttaatacgcagcagcgtgacacaactttcgggaactataatccgattgaacgagcagctaatgcatttgctgctgagcttgtcatgccagagcaaaaggttcgcgaacttttcggtggcgcaacttctgtgccgcaaatgtcagaagcatttggagtatctaacgctgctatgtcttatagacttaagaatttagggcttgtcgggtgagcgaagaagcaccgaacttcggtgccgttgatatcgcaggctctaaatttacctctccgagtcaggtgactgaacccgagacgctcctcatcgctgaatccatccggcgcaaaaaatttagccgatggttcgcaacgggaactctaatatccctgacaatcgctgcaggactttgcttagccttctccatgtgggtggggaagcacttcgtggatggtctggatcaacagaaaaataaggaagggattacggaagttgctcaagcagtgactgctcccgccatagctcccgaaaagaagaatctaaaaaccaatacttcacctaaaaaagaagatcgtcccatctcttctgcagagacggcaaaagaaattttttacattaaaattttggcacctctcatcccagcatctttctcttcagctattgcgataatattatttataaccatcgcacgcttggtcacaaatttcgaaaaaatgggccgagaaaaccctgaaaaagatcaaactgaagattacggaactatcgccgcttttttccaagaaattggtaaattaattaagagtttcaaaaaagaatagagaaaagccgccaaatggcggctttcttttgctcggcgattagcagccgatgacagggacctcataaggtttaaacgaaaccacctcctcccccagccaatcgttgatctgcagcatccttgcctgctccggctccagctcgttgactgcccacacctcggccgcgtcgcggatcgagccgaagcccccagcgttctgcggcaccacccccatcaactgaggcgggatacgcagcatggccagttggtcgtcgcggctgatgttcttgattgcgccgaagtcatccttggccgccacctcgctgatcgggatcatctgcaggccgtcctttttcccgcccggggcgtacatgaacaggttgcggaagttgcccggccccttgctgttcttcatcgctgaacgcaggtcggtaacaaagtcctcgttctgggcggcgtcggtcatgtacagaatgaagccggcgtgactgccgttctcgaagtatttccggcggaacagcgtggcgttctcattgagcagcgcgctctgcaggactggcagccactccggcaacccgtaaatctcctgattgatatcggccacgcgcaggtggcagatgctgccgggcttgaactcatgttcgtccttccctccacgaacctggtagtaggtctccaggtcggtaccgcggcgcatgtacttggccaggcacggctgtagcccgatggcctggcgcagcatgttgtcgcgcttctccaggtagagatttcccgaccatccacagtccatgacgatctgctcgaaagcctgccggctcagcagccggtgcgggatgaacgtgcgagccagcgcgttgcgcttgaagatcaaacccgactgcaggtagatgcccgccttcgacgacttcgccagtccctccaacgataccggcggcacataccaccgcccattggcccagcactccaggtaatcaagaatctctcggccatcaagtgccggcgttgggtcgccgaaggtaccgcatggaatccggcctctgtcgcccctcttacgtaacaaggattccgctaagtggttgatttcactacagagagcagggtccttgtaatcagtaggtcccggggtcgactcctggtgccggcaccatacaagggttccagagaaggctttcaaaatctctggaacccccgaaaaacccgccttctggcgggttttttcgttttgggggttctgcaaaagcgataatcctgtcgctgaatcgacctgtgctgtgctgtcaataacgcgactttggcaaaagttttacgctagtgtttccctgcgggccaagacggttttcccgtgcattgcctttaaaaacaggtgcgaacgcttatgacgaatgccacgccatccatcaaactcagcactcttcggcaaatagccccctacctgagcatgcgtggggtgtcgccgctggagttctttcggcgttacggcatttcccctcatgtttttcaaaaccctgatgcctgggtaccgcgagcggcctgttttcatatagccaacgaaatggcggctatcgcacaggaccccttcggcggtgcctgtgtggggcatctgatcgaagtacgctcgctcggtgcctggggcgagttgatattgggctcgaccaaccttgctcaggcttgcgcaacggcggcgatctataccgacttgctgcatcaaggaggagaagtagaaatcgtcaccgaaggccgtacaacgaaactgatccaccaatttaccgggcagcacggggctgatccgaagcaggtcattctcggcactctggcgctgctgagaaaagtgcctctcatgtccggtgagcctggcgccatacgcgtgcatctgcaaaacccgagggaaagaggcgatgaggcgcttgaagaatacctggggccgaatctcgaaatgaacgcgcagtacaacatgatcgaattcgaccgtgagttgctcgacacgcccctgcaacctgttcgggatgacgcctggaaagtcaccgaagccttgaggtcgacagcacaagcagcaggcgtacttatggagcggatatcggatcaggatcaatccaaacttaccgctatctcaagaaacatcggactgtcttctcgaacgctgcagcgccgtctcaagtattgcggtatcgacttcgaagatctacgcgacgagacgcggcgcagcgaggcacttcaactcattgccagcggtaaatacaccgcgaccgaaattgcctacatggtgggttacagcgatcaagcgcactttactcgagccttcaaacgctggaccgggaactcgccgtcgcgctaccgctcggccttgaaacatgattattaaaattcaagacagcgtcttcgcctgaccacttgctccctctcccacccgccccttcggcccacttcgggctaagccttccaatagcctcgaactaccgggatagggcttgccgtcctgatctgagcagccatttctgtacgagcgccgctggcaagctgatcggtaagtaatggcttggccttttggcatcaaatggcaagtttccatcgaggcgttcttatacagttttaaaaggtaatgccaaccccagcaagcactgcagcaagcgatccatgcacaagaaaagcctgaagccggggaagggaatcacttcttataagatcaagaggtttaaatgtcctactcatccacggcctgcatcgtcgccctgacgctggcaacttttgccagtgcaaacgcgcagtcatcccctgccgcggcgacgctggtgggtgtcgataactttgttcgtgccgagtccgacctgtacatgggcaaaacggtgacgagtggaggctttggtcagtttgttcataaccgtgaaccggttcctatcgacgctcagaatgtcgtccgaatgaatcgggacaccctctactcatcagcggtgttcgatctcgatgccggtccagtcacgatcacattgcctgaggccggtgagcggttcatgtcgatgcaaatggtcaacgaagatcactacgtacccgccgtcatttacggtgccggtcgccatacgctgacgaaagaggatatcggcacacgctatgtgtttgtcgctgtgcgcattttcttcgatcccacggatcgcgaagaccttgagcaggtgcatgagttgcaggacgcaatccaggtcagccaggccaagccaggggagttcgtagtaccgaagtgggatcaggcgagccagaaaaagatgcgtgatgccctggctgtcctgggttcgacaatccccaactacaaccagtcctttggccctaaaggtagcgtcgatccgatccagcacctgatcggaaccgcgacggggtggggcggaaatccgagcaaggacgccatctacctcggcggtgtgatgccgcagaacgatgggaaaaccgtttaccgtctcaaagttggacaggttccggtccgcagtttctggtctgtgagtgtttacaacgcagagggatactttcagaaaaacccatatgacacctactcgctgaataacctcaccgccaagaaaagcgataatggctcgattgtcattcagttcggtggttgtgacgcaaagatcactaattgcctgcccgttatgcctggttggaactatacggtcaggctttatcagccaagcaacgaaatactaaatggccaatggcgtttcccacagccgcagcccgtcgttctataagttcaatcattcaaataacgactggttatttagatcaattggcagacgccttagtagcgttaaacgcacggctaccaagtttgatatggcttattaagtcagggatggctctggactacagagttcacaccaaaggaactaaacaatgacaagcaaagaccattcaaattcctttagacacccgctgatgttcatcatgggtgcagccctcgcattgacgctggtgttgcctgcccatgcagcccttgacgattcaaacggcgctccatccgtgacggtaggtggcggagttgccgttggcccgttgtaccaaggctcttcacactacgccgcgttcccgtcgctgaaactgaaggcgctcttgcctacccaggactggggcacctttaccgcggccttcccggacgggctgcgttgggacttgccggggctggctcctttcggagtggccttgttgatcggttatgacccgggacgcaaggagcgcattcataccctggacggccgtgatgactacctgcggggcatgggcaacctggacagcaccgccctggtcggggcggaagcgtactggatcctgccggccggccgcctgttcgtgcgcggcctgcaatcgagccagaaccgtcattacggtggcgaaagcctggggcgcacggcgtacctggaagccggggtcgccacggcatacccactgtcttcgagcttgaccctggactcgacgctgtacggcacctggagcaatgagaacgacatgatggcgcgcttcggcgtcacggcccagcaagccgcgcgcacccggttcgatgaataccgcccgggtggcgggatgcgcgacgtgaccttgaagctgggcctcacctggcaatggcagccacagctggcactggaaggcggcatcaagacctacgccctggtcgccgacgcccgcgacagcccgctgacgggtgagaaggtcggtgccggtgcctatctgaacgctctataccggttttgataaaccggtaataccggcgccatccgatacagataagggaatgatcgatgaaaaaactacctaagcagttggggatgaccgtgtccctggccggcctattcggctcgggactgctgctcgccgaagatgccgccacccaggtcacggaccctcacttcaagctggctccaggctatctggacccggctgacttgccagtgcgcctggcgctgctcggtgccccgcccaaaccagactccgcggcgctggcgcgggatgaggaagcacggcgtgcggcgctggcgctgcgtggcaccgttcgggagaaactcgcggcagcggatgcggcgctgtcattccctggcccggcgaaaacattctcctgcgcgctgggcacgccgatcaccgagaaaagtacaccgcatctttacaccttgatgcagcgcaccctgaccgatgcgggcggctccacctacgccgggaagaatgcctataaccgtccccgtcctttcgtggtgcataaccaaagcacgtgccgcaaagacatggagccactgctgcgcacggatggttcctggccgtccggccactctgccgcgggctgggcctggagcctggtattggctgagatcaatccggcacgcgccaccgaattgatgacccgtggcctgtcatacggccagagccgggtcatctgcgatgcgcactggcagagcgacgtggatgcaggccgcatcatgggggccgccacagtggcgagcctgcatggcaatccggcgttcctggcggacctggaggccgcgaaggaggaggtcaaggctgcgcaaaaggcgggcctgaagcctacagaggactgtgcggccgagggcgtggcgctctcgctgacccagcactgatcggagaaacaccatgatgcacagtgacaacccacgctcgccgttgcggtgcaagcaggcccgcctggcgctgctggtcagcgccttgacgaccgcgggctccagtctgccgatggtggccatggcggcagacgctgatggctggcagttcaacggcgggccttacctgtggggcgccggtatccgtgggcatgtgggccaccgcagcaccgggacccagtttataaaatccgacttctccgacatcgcgcgtagcgtcgatatgtcggtgatgctgatgggcgaggcgcggcgcgggccctacagcgtactcgccgacctgatgtacatcgacaccgacacccgcaaccgtctgccagcgggcgccccggcgtccaagcttgaggtggaaagcaagacggcctcgggattcctggggggcggataccaggtgttgggggatgacgatcatcggttggacgtcgcgggcggcgtgcgggtctggtacagcagcaccaccatcaccctgcacggcgggcctgctggcggcctgtccgggtccgacaaggccacctgggccgacgccatggcggggctgcgtgggcactatgccgtgaacgagcgattctggttgtcatcctggggcatggcgggcgccggccagtcgcgggaagactgggacctggccgcgctggcgggctgggagttctggccgggcttttctgcggtggccggttaccgggccatgggggtgaattatcgccatgacggttttgtctacgacattgtccagaaggggccactgttggggatcagtgggcgattctgaggctttcatgtcattacgtttttctctgctacccatccgcagtatgtcaaaggccaaccttcgggttggcctttgttgctttacaagatcagttttttcgaacatcccgttcgatattttctcatattcacagaagccaattagattgatcatgcgccacgactcacgcagatgcgggtgaaacagtgggatggataactaacctgatcgcctatttaacaggccgtcagtcagctcaagacacacctcaagaggaagtacgcatggctaaggtattggttctttatcattcgatgtacggtcatatcgaaacaatggcccagagcgtgtcggaaggtgcccggagcgttcccggggttgaagtcaccctcaaacgcgtacccgagaccatggacccggaagccttcaaggctgcccatggcaaagtggatcagagcgctgcggttgccacgccaggtgagctgggcgactacgacgcaatcatcctgggtactccgacccgcttcggcaatatgtcgggccagatgcgcaacttcctcgaccagaccggtgggttgtgggccaagggcggcctggttggcaagctcgccagtgtattcacctcgacaggtaccggcggcggccaggagatgaccattacctccacgtggaccaccctggctcaccacggcatgatcattgtgcccatcggttacagctcgccagccttgttcgatacgtccaatgtcggcggtggcacgccttatggcgcatccaccattgccggtggtgacggctcgcgccagcctgatgcccgtgaactggagatcgcccgtcatcaaggccagtacgtggcccagctggcggtcaaactgagcaagtaggcgcccgccaggccgagctgagacagacactgcctagcgcgctctgtaatcagcaggtccggagacaaaaccaagccctcgcagcaatgcgagggcttggttgtttctgtctacgtaacaagcgacgtaacaagccgccgtctcttggtgatgaccatcaatgcgcgcaaatcgcaacctccggtcgagaccagccccatcgtcagcactgcctgcggccattccccctcaattgatcgccactgaaaacaaaaatccgcccggccgtacgttttcagaaccatccccttaaaggcatcagcccttggtaagtgtcaaaacatgcccagcggtgacgacggttctcttgccgctttcaggaattggaaaaacagtgttcatctgaataggcgtattagaagaggggaaatggaggaaaagtagggtcagaccctcttattttcctgaggcatacatcatagagagcccgattcagaaatgtctcatttcttgggcaattgcatccaaaccagaatgccggcttcagtcgatatccgggctcactaataaagccaccggtatatctgcaggctttcacacctatggggaaatggaatgcatcccagacctaacatcaccctgcatccttctgcacgagaaacgctctctcgacacaggtgcatggtgccttctcttgccattggactgctccttgcctaccaacccggtaccgccctggcggacctctccttcgatgggaagaaccgcttcatcatgacgggccagcgaatgtccgtaaccctggtcaacgacggcaagaaggccgccctggcgcaagtttcgctggactggggagagaaagagtctgggcgcagccagacactgcccctggcgatctccaaaccgttgctgcaaatctccagcggacagaaagccaccgtggaaattttctaccagggaacaggcctgcctactgaccgtgaatcttatcttctgttgagcgtcctggacgtgcctccggccgccaagacgcctcacaccatgacagtcgctttgcggcaccgcttcaagctgctctaccgcccaccgctgaagaacaccttggacgacgccatggccggattgtcctgggaaacgcagagagaaaccgcaggcaggctcatcgctgacaacccatccccctactacctgaccctcagcgatatcgaagccatcggaccgaatggccaaccctgcggccagccgatcgagcacctcatgctcccgccgctctcgacacagcccgtcgacataccggcctgccaacctgccagcctgcgttatcagatcgtcagcgacgcaggcaacctgcgcccctatggggcaacgctatccgccaaccaaaaaagccacggctcggctcaattttgaggccaatggacgagacatgatgaagaaaatctaccagttggtttgcctggccctgctactgatgcttactcagaagagctatgccctggcctgcctgaagaataacagccaagccgccgatgcaataatgatcaacaccagcatcgctgtgccgaacaccctgccgaaggatactgtgctctggcgctccgagaaccagagcattagcgtgacctgctggcaggacggcaccggcccttcagaatatgtctacctctatctgagccctcgcgacagggggttcactaagttgggacctgacctggagctcggtatcggcatgggcggagaagatctacgctgttcgcagttacccaactgccggctgcaactccctatccatttcaatggttgctccaacgaatacggttgcaagtatcaggctaaaaccagttctctgaactttaacttcttcctatccaagaagagcccgcccagcgtcggcaaggaaggaagtctcactgtagtcccgacctacccggcatttcagctggatggtatagggggtattaacccaaaacccgatagtaacttcatcatgaccttggcgggcctgagcaacttgcgctatatcgcctgctcatcgaccctgtttatctccctcaagaccgtcgactttggcagtatcgcggccctctcggcgcaagccgacaaggtgatcaaggaagtcccgttcagcatcaccaccctcaagacctgcaatagtgcttacgggctgaacgcacggctcacgccggtcgccgctaccgcggcggatggctacacactggtgccgaacaacaacagctccgtgggcatcagcctgctcaagcaacagggccgcagtgccatccccttcaacaaggaattcaccctggtggagaacagccgtgatcaggtggtggtgaatgacttcctggctcagctgaaatggctaaccagcaaggcgattctcgggaaattcaacgccaccgcgacgatcgatgtttattataaatagccccaccgacctctgacattcgcctgtcattcgaccgtttgaagaacttgaaacaagggcgccaattggcgtccttgtctttgcagggcgtggcagatcaaacggccgtcactcgcccgattacccacgcagatacagagtccggacagacggatccaggcccctccgattactgcatacgcccgcagtccgcggcctccagcgaggcgttgacaggggcggtgctatacttttttagctagtaatcagcgtgcggtgttatccagagcggcaggaaaaacggtctggaatttcagataacgactgcagaaaaaatgggggcctctgcgacgatgaagtaggaggtgactcatgaaccggcatttttacatcagcaataacctcgacgatctggaaaccgttgaaaacgagctggaagccagcggtatcagtaccgagcagattcatgtgctcagcgaccgggatgcggatgtggaacagcatcacctgcatgatgtgaattcactcatgaagcaggatgtcgttcactctggcgagattggcgcggtcattggcctaccgctcgcggcattggtactgctcggtgcctatctggcaggttggaccgagtccgcggcaggctgggtgccgttcatctttctggcgatcgtgatactgggcttcagcatctgggaaggcggcttcttcggtatccaggtgcccaatagccacttcagcaatttgaaaaagacgataaaagacggcgagcatattttcttcgtggacgtcgaacccgctcaggagccgatcctggatcaggtcatcagccatcacccacaactgcaggtcgccgggaccggcgcagcagcgcctcactggatagtggcctggctacagaaatggcatcagttcaagcgcacgatataggacgccgcggcgcttgaacgccggaggcggaagccggtcattgcccgaggaaaatcccccgggtggaaaacacgtagtccgcctcggcggccatcaggccaaccagcaccagcaggcacaacggcgggacgaggatggcgtagaccatcgccaggcgctcccaggccatgtgcatgaagatggaaacgatcaggccggccttcaacaacatgaggaccaggatcagcgaccacctgaagtagccctggaagtgaaagtagtcgaccaggtaggacagggtactgagcacgaacagcagcccccagatcttcaggtacaggctcagtggatgctgttgaccttgtgcatgtgccatcgccggtactcctctgcgggctcaccataagtagaagaaagcgaagataaatacccacaccagatccacgaagtgccagtacagcccggcgatctcgacgatctgatagttgccggagcgctcgtagtccccgcgcaacaccttgaaggcgacgatgcacaggtagatgacgccgaccgatacatgcagcccgtggaaaccggtaatcatgaaaaaactggcgccgaactgcgccgcgcccatggggttcgaccaggggcgtacgccttcggcgatgagcttgctccactcgaacgcctgcatgctgacgaaggtcgcaccgaaggccgcggtcgccagcatcagggccgcgcatttgccgcgcacacggcgataggcgaagttcacggccatggccatggtgccgctgctgctgatcagcacgaaggtcatgatggcgatcaggatcagagggatttcaacgccgccgatggtcaaggcgaacacttcgctggggttcggccaggggacggtggcgctgatgcgcaccgacatgtagccggtcaggaagcaggtgaagatgaaggtgtcgctgagcaggaagatccacatcatcgccttgccccagggcactcgcttgaacacatcctgatccgaggcccagtcgctggcgatgctcttccaccccgctaccagcgtatcgggtgggggcgggacaggattttccggaggggttgctgagggcaatgccatggcttcacctcaggccgcagaacgcggcgatggcttgataggtttccggcgtgctggtcagcagggcgaagaggacgatccacagccccagcaggtagtgccagtagatggcgcagagctccacgctgggcgccagtcgcgacagcggaacgcggcgcaggaacctggcgccgactctgccccaggccaccaggcctcccagcagatgcagcccgtgtacgccggtcagcagatagaaaaagctgttggccggattggcggagacgaaataaccccagtcgacgaactgtttccagacccagagttgccccccgagaaaggcaatcgcgaagacaccgcccagggcgaagccgaggctggccccgttcaacacaccccgccgggcggccattcgcgcccactgcaggctgatactgcccagcaccagcaggagcgtgttcagccagagttgccgggcactggccagcggcgccaacggctcggtcagcggctgccagtccgccatttgcgaacgcgcgataaaggccagcaggaacagcaggaacagcgaggtcaccaccaccaggaacatgcgcaggcccacttttgcggccttcgccctgtccaggcctgccggtccccgagagtggtcggggggctggctccagcggccgccggcaccggcgctttcggtgtttttcaatagcggcccgttcatggtctttcgcctgcgatcctggcttccgcgctgcgctgtctcatctgctccagctcctgggcagaaaccgtctgtggcacgaagtcctgctctatcccgggcacgctgtagtcataggcccaacggtgcaccaccggcagctccggcccccagttgccatggacgggcggggtgtccggcgtctgccattccaggctggccgccccccatgggttcgggcccgccggcttgcctctgaaggcgctccaggccaggttgaagaggaacagcagctggcataccccgaccgtcagcgcgacaacggtgatgaacgcattcagttgctgcgccgattgcgggatgaagtcgtagttctgccaggcgtaatagcgccgtggcatgcccaacagccccaggtagtgcatggggaagtagatgcagtaagtacccaggaaggttatccagaaatgcagcttgcccagggtgtcgttcatcaggcgcccggtgatcttcggaaaccagtggtagatggcgccaaatatcaccaggatcggcgcgactcccatgaccatatggaagtgggccaccacgaagtaggtgtccgacagcgggatatccacaatcacgttgccgagaaacaacccggtgaggccaccgaccaggaaggtgacgataaaggccagggcgaacagcatcggcaccgtcaggtggatatcgccatgccacagggtcagcacccagttgtagactttcagcgcggtcggcacggcgatgatcaaggtggtggcggcgaaaaagaagccgaagtacggattcatcccgctgacgtacatatggtgcgcccagaccacgaagctcaacacgccgatggcaatgatggcccagaccatcatgcggtaaccgaagatgttcttgcgcgcatgggtgctgatcaggtcggagaccaggccgaacgccggcagggcgacgatgtagacctccggatggccgaagaaccagaacagatgctggaacaggatcgggctgcccccctgatgcgcgagctgctgccccatggagatcaccgccggcatgaagaagctcgtgcccagcagcctgtcgaacagcatcatcaccgcgctgacgaacaaggccggaaaggccagcagggccaggatcgaggccatgaagatgccccagacggacagcggcatgcgaaacagcgtcatgccacgcgtacgggcctgcagcaccgtggtcacgtagttcagcccgcccatggtggcggcgacgatgaagatcgccagcgacaccagcatcaacacgatgccccattcggtacccggggtgccctgggtgatggattgcggcggatagagtgtccagcccgccccggtgggcccgcccgggacgaagaagctggaaagcagcaccaggaccgagagcaggtagaaccagaagctcagcatgttgacgtaggggaagaccatgtcccgggcgccaatcatcagcggaatcagatagttgccgaagccgcccaggaacagggccgtcagcaggtagatgaccatgatcatgccgtgcagggtcatcgcctggtaataggtgctggcgtccatgaactcgaggctgccgggaaagccgagctgtatgcgcatcaggccggacagcaccagggcgacgagccccacggagatcgccgtcaaggaatactggatggcgatgaccttgtggtcctggctccagatatagcgcgtgaagaagctcttcggttcgtgcaggacttctgtttctgcatgctcgacataagccatcaggtcatcctccggtaagtttcggagcatttccggcgagttacggcgacttgcccgattccaccttgccggcatccgcgtcgacagcagctttcgacttgatgaaggcgatcagggcgtccagttccttgtcattgggggtaaaggtcggcatcaccgcggcgtaacccttgacgatcgcggcaccagggtggcgcacggaatccttcaggtagccctcatcgaccttgatctgagaaccatcggccagggtttgcatcttgccgtacaagccctgccaccccgggccgataccctggctgccatcgacactgtggcacgccaggcaacccagcgattcggccagccgctgtccctgcgccgccagctcattctgtgcgtctgcagggccttgttctttctgccccacggcactcagcgacttgatgaaagccaccacggcggccagttcatcctgactgaaagtataggccaccatgaccggcggatagccctggaccagcctggcctgcggctcgagaatcgactccttgaggtaggcttcgtcgacctggacgcgggtgccatcggccagctgctccgagcggccgtacaggtccttccagcccgggcccaggctggtgctgccgtcctggctatggcaggcgtggcagccatggctttccaccagttggcgacctttttccagcaggctgtcccggcttggcgtggcgacattggtcagggtctgggcaaaggtcggctggctggcgaaccattggtcgaaagcgccctgctcctcgacgaccagatggccgcgcatgttgtagtggcccaggccacagtactcggcgcacagcacttcaaacttgccgagccgggtcggggtgaaccagaagtgggacaccatgcccggcaccatatccatcttcgcgcgcatctgcggaatgtagaaatcgtgcagtacatcctttgcccgcagcaggacttttaccggacgatcgatgggcaggcgcacttcattgttcatgatcagcacatcgtcctgcccggcagggtcattgcgatcaagaccgaaggggttgctgggatcgatccatttgacatccgccttgccgagttttccgtcctgtccgggaaagcgaaacgcccactgccactgctgggcaatcacttcgagctgagtcgcctcttgcggcacctggacgaaatcgttgtagaccacaaggccgggcgcgagcatgccgatgatgcccaatgaagtgaggatgaccagccacccttccagcttccggctttccggctggtagtgcgcccgggcaccttcgcgatgccggaagcgaatcacggcgatggccatgaacagcgtgatggcgatgaaaaagattccggtgatgaccagggtgatcagcagcgtggtgtctatcgacccccagttggaggcagccggcgtcatgtgccagggagcaagcaggtgaaacagcaccgaagcgacaacgactagaaccaggatgattgctatcgccattttctcgtcttcctgtgccggttgttctgtggccgtgcaaacgcaacgtcgcccaaccgcagcgccacaccgatgcctaaccctcctcccaagcctgctggaacattgcctctatccccggggcaaatcttctgaaaagtatagtgcgccccggcggacgtgcgccgccgggccccggcacgacaccggccagagggctatggcctcaccacgttcctttcccctgattgccatccccaacactcgccaagcatgctcaaatagccccccgcttttgccacccgccacacccgatccggagccgtacatgaaaaacacctttgccctgaccttggccctgatgctcagcctgccgtcgctccacgcccaggcagaagcagtgggcgatgccgaagccggtggcaagctgttcaagcgcatctgcggcggctgccacaatatcgggccttcggtgcgcagctctttcgggccgcagctcaatggcattttcgggcgcaccgcggggagcgtggcggactatcactactccgacgcgatgaagtcctccggcatcgtctggacccgcgacaagctggtggcttatctggaagatccaaaggccgtggtgcccggtacgcggatgattttctggggactgagcgatcaggagaagatcgataatctgctggcttatctgcagagctttcaggcgcaacagccctgaatgacctgacaaatcaaagcggccccaaatcctcaacgggcgcttcgcgcccgatcgcagcctggcggcagcggctacagggagccgcggtgctggacggggcaacacccacaaaaaagccccgaaccagtcggggcttttgctattgccggcccagtatcaggccgcgatcaggtgtttatcagaacacgttgatcgggtagtcgacgaacacacgcagttcgttaccgctgtcgttgtagtcgctggatttctgcgatacacgcaggatcgagctacgaaccttgacgctcaggtccttggccgggccgctctggaccacgtacttgaactggttgaagatttcgcgctcggtgccgccggaggaggtggcagtggtgatgttgtcgccacgcacgtaagccacgttgtaggtcagacccggtacgccgaaggcgccgaagtccaggccgtagcccagctgccagctgcgttcgtcttcagcgttgaaatcggaccagtaggagttggccaggtagatggtgttgccgccatcgcccacgcggttctgccctttctggtaaccgccgtaggcgtaacccaggttgctgtcgccagtgctgcgctggtgcgccagggtgaacgagtgcgggccggtggcgtaagtggctgccaggctccagatcttgttgtcctggccgcccgcgttgacatcttctgcgtaggacttgtccagcttggtacggtagccgttgaagtcgaaagtcagggactggtcggtggccagcgggaacacgtagttcaagttcacgtactgcttcttcagcacgtcttcgacgtcggaagcgtacagcgagcccttgaactgttcggtgaactggtagctgccgcccaatacgttgatcgacttcaggccaccgctgtcacggccttcggcgcttttacgcgattcggcggtgaaacgaccggcgttcagctccaggcccttgatctctttggaggtgatcagggtaccggtgtagctttccggcagcagacgcccattgtcgtagctcagcaccggcagggccggcatctggtcaccgtaggtcaggacggtgttggacaggcggaatttgaccgcggcgccggccttggccaggtcacctgccgggctcttgttgccgccttcgcttggcttgaagaagtcgatgccctggccgccgctgtggctgcctttatccaggcgcaggccgtacaggccaaaggcatcgacgcccacgcccacggtgccttgagtgaagcccgacgagaaggtaccgatggccgcttgaccccactcgcgctggtcatcgttaccgtttttcttgtcgcgattgatgtaggcgttgcgcagcagaattttcaggctgctgtcttcgacaaaccccttggactcagcctggtcgttagccataacttgagtactgctcagaatccccagtgcgatcagaccgatccgcttgttcaacattttattttccttattacgggttgatgacgcgctgtggtgctccttggaaacggcgcttaagcgctcttttttcaggccagaacaaaaagacccacccacgaagaatcgcggtgggccttttattattggaaggtcatggccgttggccacaggcgttggcgcgaatcctatccgcgccccgaacagtgtgtcaatttcaagaatcgtctgaaaataggcaaaaatcgtctaagaacttaacgatccttgatggccagttgcacgatatggctgtcgacgaactgttcgaagtgcgtgaccttgccatccttcaacgtccataaatgggccacgcgggcattcagcggtttgcccgtggctttatagacgccgctgtagttgccgtaggcgaacaccttgtcgccctgggccacatagttctcgacggtgaaggcaaacccctcccactcggtggccaggcgcttgaagacattctccaccacggcatcgaaaccgacgtaggtgccggcatagggaaaacctgccgcttcggtccagcgcgcatccgcagccagggcggcggcggtatttttcgcgttctcctgggagttggcgccttcgtaggtgcttttgatcagtgccaggttatccatgggcgactccgcaaattaagggggggttcaaagggcgcaaccgttcaggccacaggcttgcaggctaggtgaaagctcgacctcgggcgaaccgaaggcttcgctcagccaggcggcgaacgcctgcggcttgcccagccagggactgatatcgagcagcctgaactgaccgtcctgctccagcaccagggtcggaaaaccctggccaccgacctgggccaacaaggcacggctggccttgatgtgctcgttcaggctgttcgccgcggcgtactcgaaggcttcctcgaactcgccgcgctcaaagcccaggccttcggcgagttccaacagaacatcgacatcggcgatgcggcgcccttcgacgtagtgagccgtctgcaagcgcccgagcaactccaggccgcgcccggcgagcgcctgcgccgccagtaccgcggcaatcggcggggccgaatcgaacagcgccgaatagtcgcgcagcaaaccttcgaagtaagcctcgccgaacggctgcccggtgtattcggcaatgcgccggtcatggggcatgacgtagtcgcgcagttgcggcgaaacctgctggcagttgcgcccggtcatcatgccgccgccatgggccaccaccggcagcacggcctgggccgcctgcaccagcggtttggcgccgtagcaccaaccgcacaaaggatcgtagatgtaatgaagggtcgctgccgacatgcaaggctccgggacaaaggccgataaattcgatggcggcagactatgcctgtggcccacggcgaaaaacgctggaatggcttttagtctgtttcgggaatcggtcgaatcggccgtgtatccactgcatttcaatcaagacacaaattgaaacaatccgcccggggaacttttcaagaatgattaacgaaagtaaatagcaagcattaccattcgcgccgatagtttctttccccatctggatgcgtttttccatgcctgcccccttccgcctgactcccctgacccttggcttttgcgcctcgctgacggccggtttcacctgcgccgccccgaccaccttgccggctaccgccatcagcgcagaagtcgatgccgacgacccacgggtcaaggaagtcagtaccgcgacccgcaccgccacgccggtgcgctacgtgccgcaagccatcgactcggtaaagactagcaacgtgctggactacggcataaacgacctgggcacggccttgagcggcattcccaacgtcagcagcggcgccgacacccgcttcgacagcctgcgcattcgcggtttcgacgccagcaacgacttctacctcgacggcgtccgtgacgacagccagtacgtgcgcgacctgcacaacatcgagcgcatcgaggtgctcaagggcccagcggcggtgctttatggccgtggtagccagggcgggatcgtcaaccgagtgagcaagctgccgcagttcggccgccactccagcgtcgaagtcaaaggcggcagcgaagacctgcgcagcctgtatgccgacctcagcgccgaccccagcgagaacatcagcctgcgcctgaacatgggcaaccaggacaacaacagcttccgcgacggcgtcagcggcagtcgccagctgttcgcgccgtccatgagctggcaactgacgccggacctgaactggctggtgcagtacgaatacagccgctacaaccgcacgccggaccgcggcatcccggggatcgacgggcgcccggcggacgtgagtcgcgacaccacctacggcgaccagcgcgactacatcgacgacaagtcccagtcgctgcgctccaaactcagctacgagctgaacgacaactggcaactgcgccataccctgagcctgttcaagctcaacagcgatttcgacaacacctaccagaccggctacgacagccgcaccaagcgggtgaaccgccagcgctggcagcaggacctgaacacccgcaacctttacaacaacctcgaagtcgaaggcaccttcgatacctttggcctcgagcaccgggtgctgacgggtgtcgagctgggcagccagcgacgcgatccgaagctctataccgcagcggcggtcagtgccggtggccaggccgtgccgtccctggacccgttcaacccggataaaaacatgcggcataccgggaaaatggtggcgtccagctacaaccacagcgaggtggaaagccgcgccgtgtatgtccaggatcagctgcgcctgaacgatcagtggcaagtgctcgcgggcctgcgctacgacaacttcaacgtcgagacccacaacaaactgctggatatcaaggacgaccgcgacagccacagcaccagcccgcgcctgggcgtggtctggaccccgctggagaaccactccttctacgtctcctggagcaagagcttctcccccgtcggcggcggcctgatcggcattaccccgaatgccaacggcaacagcaacgacctgagccccgagcgcacccggcagaaggaaatcggggtcaagagcgactggctcgacgaccgtttcagcaccacgctcgcggtctatgagctggagctctacaaccgtcgcagccgcagcgtggaagacccgaacgtgatcctgctgaccggcctgcagcgctcacgcggcgtggaactgaccgcggccggcaagatcgtcggcaactggtccgtgcgtggcggcatcgggttgcaggacgcaacggtggtcaagagcaacaacggtgacgaaggcaaccgggtgaacaacgtggccaagcgcaatggcagcctgttcgtgacctggaagccggaaatgggctggtacgccgagaccggcctgaccctggtgggcgatcgttatgccgataacgccaacaccgtgatgcttccgggctacggccgctgggacgccctggccggcttccggcagaaggactgggacctgcgggccgcgctgaacaacatcagcgaccgcacgtattactcctcggccaccagcgccgggcagatccagttcggcgatccacgcagcctggtggtaaccggtacctacagcttctaaaaagcagccatggatacggccgccatcgcctgagcgcggtggccagccttgcgcccgctgcgcggccgatcgcagccttcggcagcggctacaaaaacctcgaccttgcaccctgctcactccctgtagccgctggcgcagcctgcgatcgacggcgcagccggcgcaaaacccaggtacacccttcctgctgacggaccgcggtggcagattcgcgtccgctgcgcggccgatcgcagccttcggcagcggctacattcgcgcaaaaaaaagcgctgccatccgggcagcgcttttaccaatccgttgtttgcctatccttccagcacatcccacaacgcttcgagttccgcctcgctgaacaaaccagcagggtaacgatcgaggatcatccggcgcgggtcggtttcccggacctgtcgcgttccattgcacttcaaccattgcgccagaacctgaagcgactcgctatttattgcggaagtccgctcgctgaccctattcatttccagcgctctctcccggtttgtgagcggctaacttatccaaggtttatgacagaacatcgcagttccacccgcctcggattgacctcgcgagagatacaagagctatgccaaggtctcgcaatggccagattccggatccaaaaaaacccgcagtccatcagggctgcgggcttgccgggcgacgccggattggatccatctaaccgcccgtcattcaggcgtcacgggctgttacaacaacactcaaaccttgtgcggcgccggttgctgttgggtaaggcaatggatatttccgccccccagtaacaactcgcgacccggcaccatcaccacctcgtgttgcgggaacaggttctgcaggatttccttggcctgggcatccagggggtcgtcgaaactcggggcgatgatgccgccgttgacgatcaggaagttcacataggaaccggccaggcgcaccgacggattacgctcctgggtgccatccaccgggtcgacgcccgcgcactcttcttcggtggcatacagcggtccgggaatcggcatcttgtgcaccgtgaacgggcgccccttggcgtcggtgctgtcttgcagcactttcagcgccgcctggcagcgcgggtagttcgggtcctgcgggtcgtcggtccaggccagcaatacttcgcccgggcgcacgtagcagcagaagttatccacatggccgtcggtttcgtcgttgtacaggccgtccgacagccagatgactttatccacagccaggttggcgctgagcaccgcttcgatctcggcacggttcatgtgcgggttgcgattgcggttgagcaggcattcctcggtggtgatcaccgtgccttcgccgtcgacgtgaatcgagccgccttcgagcacgaagccctcggtgcggtaacgcgggctgcgctcgatctcgaggatcttgccgcccacctgcgaatcacggttccacggcgcatacaggccgccgtcgaaaccgccccaggcgttgaaatcccagttcacgccacggacttcgccctggtcgttgatgacgaaggtcgggccggtatcgcggacccaggcgtcgtcgctggacatctccaccaggcggatattcggcacgtccagacgcgcccgggcgttttcatactggcccgcggagaccgccacggtcaccggttcgaagcgggcgatggccttggccaccgctacgtgcgcggcctgcgccggcttgccgcccaggcgccagttgtccgggcgctcgggccagatcatccaggtctgggtctgcgtcgcccactcggctggcatgtagaagccgtcggcgcgaggggtgctgtgcaaagtggtcatgggttcaggactccagggaaccgtcgagggttttgatcgcgctgtacaggttcggccgacggtcgcggaacgaaccccaggcgctgcgaatgtgttccagctcgtcgaggtcgaaactgtggacaagaataccttcttcagtctcgttcagttcttcaaccttctcgccgaactggttggcgatgaacgacgagccatagaaggtgatgtcgtagccgtcctgctcttcgttgccgatgcggttgctggcgatcagcggcatcaggttggcgccggcgtggccttgttgcacgcgctgccagtggtcgcgggacgaaatgttcttgtcgtgcggctcgctgccgatggcggtcgggtaaaacagaatctccgcgccttgcagcgccatgctgcgggcacactcggggaaccactggtcccagcagatgcccacgccgattttcgcgtagcgggtgttccacaccttgaagccggtgtcgcccggattgaagtagtacttttcgtgataaccggggccgtccgggatgtggcttttacgataaatcccgaggttgctgccgtcggcgtcgatgatcgcgatgctgttgaaacgcgcccgcccggccagttcatagaagctgatcggcagcaccacctgcagctccttggcgactttctggaagtgcgcgatggccgcattgctttccaccggagtcgccagctgcaggtagtccgggttcggcttctggcagaagtacggggcctcgaacagttcctggatcaggatgatctgcgcgcctttggcggcggcctcgcggaccagcttttccgcggtctcgatattggcctcgaggtcccaggaacaggccatctgggttgcggcgacggtaacgatacggctcatggatcatctcctgggcagcagcaaaggaccgagggtggcatcggtcgatgacagaaaaagggcaaggccgaggcggtttgatcatggcctgggccgaggcagcttatatccgataaaaatcgactttaaaagcgtaaaaatcacttatcaaaaaataaaccccgacaaacatcgatgtttatcggggtttagtgtgccagtgccgacgctatcgcgagcaagctcgctcctacaaaaggcatgccctttcccctgtaggagcgagcttgctcgcgatccgaatgcgcagcattcggggggctacagcccctcctccagcaccttggccaacatgtcgacaaagaagtcgacgctctggcgcgtggtgaccatcggcggcttgatcttgaggatgttcaggtcatcgccggtgggttgcatgaagatccccagctcgcgcaggcgatcgcacagcagggcggtctcctgcgtggccggctccagggtctggcgatcgcggatcagctccaggcccaggtagaaccccgagccatgcaccgcgcccaccagcggataacgctcgatcagggcttcgaggcgctgcttgaagtggccaccgaccacctgggcgttttcccagagtttttcttcctgcatcacgtccagcaccgccatgccgatccggcaactcaccgggctgccgccggccgaggagaagaaataaccttcggcctccagcgcttcggcgatctcccggcgggtgatcaccgcccccagcggctggccgttgcccatgcctttggccatggtgatgatgtccggcaccacgccctgctcttcgaagccccagaaaaacttgcccatgcgcccgtaaccgacctgcacctcatcggcgatgcacacgccgccctgggcacggaccagcgcatagacctgcttcaggtaacccggcggcagggcgatgccgccagcgttgccatacaccggctcgcagatgaaaccggccaattggcgattctgctccgccagcttggccaggttgtgttcgacgctgcgcacgtagtccgcggtgctgtcctggccgcggaactcgccacgataggtattgggcgcggtcaccggatgcacccagtccgggcggctgctcagggcttgggggttgtcggcgatcgaggtggacaccgcatccgcgcccaccgtccagccgtgataggcctccagcacgctgagcaggtcgcgcccgccgctgtaggcccaggccaggcggatcgccaggtcgttggcctcgctgccgctgttgaccaggaacacccggtccatggagtccggcgccagctccagcaagcgctcggagaactcggcaatcgccgcgtagtggaaacgcgagttggtgttgagcagcgaccattggcgcgcggcctcggcggccatccgtggatgtccgtggccgagcaccgcgacgttgttgagcatgtccaggtaggaacggccctgcatgtcgatcaggtggttgcgccagccgcgctcgatgcgtggcgggtcgacgtaatagtgcttctgcgaacgggcgaaactggcatcgcggcgcgccagcaaggcgtgcgagtcgagctccggctcggcgtcgcaggccaggcccagcagcgccgccggcgacgggcacagcgcctgccatgccgcggcccgcgagggcgtgcagaacagcggaggatcgagctgcgcgccacggcacagctggaccttgagcccgccatccaccgcccccaggacctggcctttgaccagcgccgcgccggcatgcaccgagggcgtgacgccccacagccgcacactcaattgcgggccatcgaggcgcaacacaccgtcggtggcgcggtgcagcaccccggcaaaaggcgcttcgaccgccgtgcccgacggtacctgcaactgcacgtgcaacgggaaggtgtccggctcgacggcactgtccgggcaggtccgggacaggcggtactgcccataacgactggccgccaatccatgggccgccacggcctgctgcaacagctgggtatcgatctccggctgctcccagttgccggcctcgaaatgcgggctgagcacgcccaggtcgatcagggcgaactcgcgccccaccaggcccggcagcaagggggcgaaaccttcgctggcgatggccggcagagactggccgaccgccgcgaggatcgccgcttccatcaactcgaacggcaccgaggtggcgacgcgaaagatctcccattcgtggctcaggttgtcgcggctgtactggttgcccgggtcgatgctcacctgctgttcgccactgagcaccagcaccgcggcacgggccacgatcagcggccacagcaccagcagctcggcctgctgcagtggattgaccgcgtgataggcacggaccgccggcaggatgcagaacggatcgccctcggcatggtgcagcagcgccgcgcaggtcaccgacaggtcagtgatgcgccaggtgcggatcaggtcgccgaaatcgatcaccccctgtacctgccagtgacgctgagcgtcacgctgccagaccacgttgtcgtcggtgatgtccaggtggatcgcctgcaccggcaactgctcggccaggcgctgcacacggcgctcggcctgctcggccacttcggcgatcaggctgcgttgctgttcgtcggcgatcaccggtaacaggtgattgatcaggctatgggcgtggcgcgcgtcccattgcagggtgcgttccaggcccgggtgctggaagtccgccagggccagatccatctgcccgcacaaccggccgaagccggccgccagctcggggcccaggtgcttgaggtgggtcagcggctggccttcgatgtagtcgagcaggcgcacatgcagcgcctggccagcgacctccagggacagcaggtcggcaccattcttcgccgggatcacccggggtacgtgcagctcggggtggctgcccaggtgcttgagcgccgcatgttgcgcctgcagttccagggcggcgtagtcgccacggcagatcttcaggacaaaacgcccccggggactgtcgagccggtagttgagatcctgctggctgcccaacgattgcagcgtgccgccaaggccgtaatgcacttcgagcaggtccagcgcctgctgcggggtgacttgcggaccgggcagactggcgcggtgaatcaacgtggcgagcaacatggaacgacccctggaattattgtcagatgcgtatatcgccactgcgccaggcgttacgcaaccccctggcccgggcaggcgacaagggctgcaccgccgccgggaagctaaacaggatgccaatacccgggccagacatcggcggcccttgcagcggccgctggctgccgacaagctatgctccattcgcgactccatgtcttagggaagaaggcctacccatatgcgcattctcgttaccggcggtgccggctttattggatcggcgctgattcgccacctgatccgcaacaccgaacacgaggtgctcaacctcgacaagctgacctacgcaggcaacctggagtcgctttcgagtatcgccgccgacacccgctacgagttcgtccaggccgatatcgtcgaccaggccagcgtcagcgccgtgctcgagcgtttccaaccccaggcgatcatgcacctggccgccgagtcccacgtcgaccgctccatcgacggtccgtcggacttcatccagaccaacatcgtcggcacctacagcctgctggaagccacccgcgcctactggcaggccctgccgccgacggaaaaaagcgccttgcgtttccaccatatttccaccgacgaggtgtacggcgacctgcacggcgtcgacgacctgttcaccgaaaccacgccctacgcccccagctcgccctactccgccagcaaggccgcgtccgaccacctggtccgcgcctggcagcgcacctacggcctgccggtactggtcaccaactgctcgaacaactacgggccgttccacttcccggaaaaactcatcccgctggtgatcctcaacgccctggccggaaaaccgctgccggtgtacggcaacggcctgcaagtgcgcgactggctgttcgtcgaagaccacgcccgcgccctgctcaaggtggtgaccgaaggcgtggtcggcgagacctacaacatcggcggccacaacgaacagacaaacatcgacgtggtgcgcggcatctgccaactgctggaagagctggcgccacgcaagcccgaaggcgtgcagcactacgccgacctgatcactttcgtccaggaccgccccggccacgacctgcgctacgccatcgacgccggcaagatcgagcgcgaactgggctgggtaccgcaagaaaccttcgccagcggcctgcgcaagaccgtgcagtggtacctggacaaccaggaatggtgccagcacgtgcaggacggcagctaccaagggcaacgcctcggcttcactgacttcaaggatctgatcgcatgatgaaaggtatcgttctggcgggtggctcgggcacccgcctgcacccgatcaccctgggtgtgtccaagcaactgctgccggtctacgacaaaccgatgatctattacccgatctcggtgctgatgctggccggcatcaaggacatcctgctgatctccaccccccaggacctgccgcagtaccgcaacctgctgggcgacggcagccagttcggggtgcgcttcagctacgccgaacaaccgtcgccggacggcctggcgcaggcgttcctgatcggcgagcaattcattggcgacgaccctgtgtgcctgatcctcggcgacaacatcttccacggtcagcatttcaccgagaagctgcagaacgccgcggcgaaaccgtccggagcgacggtcttcggctactgggtcaaggacccgcagcgctttggcgtgatcgacttcgacgcacagggcaacgccctttcgatcgaggaaaagccccagcaccccaagtccagctacgccgtgaccgggctgtacttctacgacaactcagtggtcgagatcgccaaggcggtcaagccttcggcgcgcggtgaactggaaatcaccgacgtcaacaatgcctacctgcaacgcggcgacctcagtgtcgaacgtttcggccgcggcttcgcctggctcgacaccggcacccacgacagcctgctggaagcctcgcagtacgtgcagaccatcgagcaccgccagggcctgaaagtcgcctgcctcgaggaaatcgcctacaaccagggctggatcgaccgcgagcatctgctcgaacacgccaagtatttcggcaagaccggctacggccaatacctctacagcctggcgggagaaacccaatgaaggtcctggccaccgaactgcccggcgtgctgatcatcgaacccaaggtctttggcgacgaacgcggttttttctacgagagcttcaatgccaaggcgttcgaagaagcaaccggcgtgcgcacccagttcgtccaggacaaccattcgcgctcgcaaaagggcgtgctgcgcggcctgcactaccagatcgaaaacacccagggaaaactggtgcgggtggtcgccggcgaagtgcttgacgtgacggtggatctccgtcgcagctcgccgcacttcggtaagtgggtcggggtgcggctgtccgcggacaaccatcgccagctgtgggtaccggaaggcttcgcccatggtttcgtggtgctgagcgagtacgccgagttcctctacaagaccaccgactactacaccccggcgtccgaacgctgcattcgctgggacgatccgaccctggccatcgactggcaactcacaggcccggcgcagctctcggccaaggatcaggccggcaaattgctcagcgaagccgagctgttcccatgagcggccgcttgaagatcctgatcagcggccagcacggccaggtttcccaggccctgcaacagcgcctgggaaaccagcacgagttgatcgtgccggggcgcggcctgctcgacctgacacgcccggacgccattcgccagcaagtgcgcagcctgcgcccgcagttgatcatcaacgcggccgcccacaccgccgtcgatcaggcccagagcgagccggacctggccttcgcgatcaatgccagcgcccccggcgtgttcgccgaggaagcacgggaactgggtatcccactgattcactactccaccgattatgtcttcgatggcagcaagcaggccccctacaccgaagacgatgaacccaacccgctgagcgtctacggccagagcaaactcgccggcgaacgggccatcggcgcagccggtggcgaacacctgatcctgcgcaccagttgggtgtattcgaacaccggcaagaacttcctgctgaccatgcaacgcctgctgcaggaaaaaccgcacttgcgcgtggtcgccgaccagatcggcgcgcctacctgggccggcaccatcgccgccagcaccgccgccctgatcgagcgctggcaggccggccagccaggagcctgggggacctaccacctgactgctgctggcgagacctcctggttcggcttcgcccaggccattggcgagcacctgctggcccaaggcaaagcctgcgcgaccctggaggcgatcccctccagcgcctatccgacacccgcgccacggccgctgaactcgcgcctcgattgccgccgcctggagcgcgagtggggcgtgcgccagcctgagtggcgcagcgcattgctcgagtgtcttgccgggcagggctaggttctgcacggaaagtcgccgagcggcgatcaggcaaggcgcaacgaccagcgggagtaacagccaagggctggcccgaagggtgagcgcagcgaatcaaaacaggcgaggaacggccggggtcgcgctcgactgtaggggcctacatgagcattccgagcctgtttttaacgcggcatgatcgtcgcgcaggcagtttacgtatagaacctaggcataatgcgcctgtacccacaggcgcatcgtccccatgactccacctctcccccgacgcccccgctggcgtagcctggctttgctggccctgtgcctggcgccgctgctgtggccgctggagcacctggccgagcgttattaccgcagcgaactggcgggccagaaccgccagaccctcgacctctacgtcgccaacctgctgggcaccctgcaccgctatgaggtgctgccgcagattctcggcgagctgccggcgttgcgtgcggtcctcggcgcgccggacgacggtgtgacccagggcaacgccaaccgcctgctgaaaaacatcagtgcccagaccggggccgaagtgatgtatctgatggacacctccggcaacaccctggcggcgtccaactgggacaagcacgacagtttcgtcggccgcaatttctccttccgcccctatttcagcgaagccatggccgggcgcctggggcgtttcttcggcctgggcaccacctcggccaagcgcggttatttcttcgccgccgccgtgcgcaacggcgagaaaatcatcggcgtgctggtggtcaaggtcgacctggaccacaccgaaagtctctggggcaagacccccgagcaactggtggtcaccgaccacaatggcgtggtgatcctcacctcgcgcgcggaatggcgtttccgctcgacccgcccgctgactgaagacgaaagccaggccatcgtcgccatccagccctacccgacccgcgatccacggccgttgaacctcgactccaacgcctggctgacccagacccggcagatcgacgaaaccggctggagcgtgagcatcctcgccccgcgcaccctgatcgaccgcccggtacgcaccgtggtggcggtgggcggcgccacgctgctggtcttgatgctgctgctcggcttgatgatgcagcgtcgtcgccactacctggagcgcatcgccttcgaagccaaggctcggcgcgagctggaaatgcgcgtggccgaacgcaccagcgacctggaaggcctgaaccgccgcctcaggcaggaagtgctggaacgcgaacacgcccagcaggaactggtgcgcgcccaggacgacctggtgcaggccggcaagctctcggccctgggcaccatgtcggcgagcatcagccatgaactcaaccagccgctggcggcgatccgcagctacgcggaaaacgccgaggtgctgctggaccaccagcgcaccgaggacgcccgtggcaacctcaagctgatcagcgagctgaccgggcgcatggcctcgatcatcgcccacctgcgcgcctttgcccgccgcgaccgccacgcgccggaaagcgtcgccctgcaaccggcgctggacgacgccctggcgctgctggccaagcgtcgacgggcgatggaagtggagctgatccgcgacctgccggcggccactctgtgggtcgaggccggggagacgcggctacgccaggtgctcggcaacctgctggccaacgccctggacgcgctgaccgaaaaaggcccgccgcgcaaactctggctgagtgccgaatccaccgccacgggcgtcaatctgtacattcgcgacaacggcccgggcttctgcatggaggccctgggccgcgccggcgagcctttctacaccaccaagacccgcacccagggccttggcctgggcctggcgatctgcgacaccctgatgcgcgcctttggcggtgaactgtcgttctccaaccaccgcgaaggcggcgccctgattaccctgcggctgcgcgccggcgcgccgggagtgagcctgcaaccgtccgaggaccgcagcgtatgagtacaccgatcaccagtgacgtacaggtggtgttgatcgacgacgatccgcacttgcgccaggccctgagccagaccctggacctggccgggctgaagatcctgccgctgggcgaagcccagggcctggccgcgcgcctggagcgcgactggccgggggtagtggtcagcgacatccgcatgcccggcatggacggcctcgaactgctcggcgaactgcacggccaggaccctgagctgccggtgctgctgatcaccggccacggcgacgtgccgctggcggtgcaggcaatgcgcgccggggcctacgacttcctggagaaacccttcgccagcgatgccctgctcgacagcgtgcgccgcgccctggccctgcgccgcctggtgctggacaaccgcagcctgcgcctggccctgagcgatcgccaggagctcagcgcgcggctggtcgggctctcggcgccgatcctgcgtttacgtgaacagatcggcgccctggcagcgaccaaggccgacgtgctgatcctcggcgagaccggcgccggcaaggaagtggtggcgcgggcgctgcacgacctgtcgagccggcgcaatggcccgttcgtggcgatcaacgccggcgccctggccgaatcggtggtcgaaagcgaactgttcggccacgagccgggggcctttaccggcgcgcagaaacgccgcatcggcaagttcgaattcgccaacggcggcacgctgttcctcgatgaaatcgaaagcatgagcctggacgtgcaggtcaagctgctgcgcatgctgcaggagcgggtggtggagcgcctgggcggcaatcaactgatcccgctggacatccgcatcatcgccgcgaccaaggaagacctgcgccaggcggccgaccaggggcgctttcgcgccgacctgtattaccgcctgaatgtcgcgccgctgcgtattcctccgttgcgcgagcgtggcgaagacgccctgttgctgttccagcatttcgccgacgaggccagcgcccgccacggcctgccgccccacgaactgcaaccggggcagcgcgccctgctgctgcgccacagctggccgggcaacgtgcgcgaactgcagaacgccgccgaacgcttcgccctcggcctggaactggccctggacaacagcgcgccggacggcagcccacaaccggcgccgacggtggtcgagggcggcctgagcgagcaggtggagaacttcgaaaagagcctgatcgccgccgagctggctcgctcccacaactcgctgcgcagcctcgccgaagccctgggtattccgcgcaagaccctgcatgacaaactgcgcaaacacggcctgagcttcggcgacagcggcgccagctctggtggcgacgatagcgagtgagcgatgccgactaatcttgttaatgcaccatttcaccaccgaggccctgcatgaaccgcgacagtcgtcacctggaatccatcctccatcacgacattcccctgacgcgggacatgggcctgaaagtgctcgactggcacgcgcatgagctgcgcctgcaactgccgctggaagccaacgtcaatcacaagagcaccatgttcggcggcagcctgtattgcggcgcggtgctggccggctggggctggctgcatctgcggctgaaagaagcggggatcgacgacgggcacatcgtgattcaggaagggcagatcaactacccgctaccggtgaccagcgacgccacggccatctgcgccgcgccgagcgaagaggtgtggcacaggttcctgaccatgtatgagcgctacggccgcgcgcggctgatcctgcacacccgggtggtgaatgccggcagcgatgaagatgcggtgcgtttcaccgggcagtacgtgttgcaccgctgagcctgtagccgctggcgcagcctgcgatcggctgcgcagcagtcgtaaacggccagcgcggtgtgtcagacggaatatcgccagtcgatccacagccgcttcgcgcgcaggctgcgccagcggctacaaggatcagccgcgcgccagctccagcaagcgcccacgccatgcggccttggccggtagcgccaggaagaagccattgagcagagactcccgcgccgggtagcagaacggtgcgccactcagatccaacacctcgcctccagcgccctccagcacgccttgggccgccgcggtgtcccactgcgaggtcggcgccagtcgcggataacaatccgccgcgccttcggccagcaggcagaacttcaacgagctgccgatgttcgccagctgcaactcgcccagggtcgcgctcaacccggccagcagacgctcctgctcggggctggtatgccgacgactggcgaccacggtgaaggcttcgcccgccgtcaggctgtcacgcacgtggatcgccaccggcgcctggcccttgtccgcgcgccaggccccaaggccggcgccgccgaaatagcagcgaccgctggtcggcatcgataccacgccgaacaccacccggccgtcttcgatcagggcgatattgacggtgaactcttcgctgccggagatgaactccttggtgccgtccagcgggtccaccagccaccagcgctgccagccggcacgcacgtcctggggaatgtcggcgtcttcttcggagagcaccgggatgctcgggtccagcgcggtcaggccttgcacgatcaggtggtgggccgccaggtcggcggcggtcaccggcgactcgtcggccttgctggtgacggcgacgttggcgcgccagaacggcaggatcgcttcgcccgcctgcaaggccaggtcgatcaccggcgccagtaacggatggggaaaattcatcgatggttcactcatgcttggaaggcgccgcgctgggtcagcaggtcgcgggccaggtacagcgcggccagggcgcggccctcggtgaattgcgggttctgcgccaggctcgacagctcgcgcaggttgatcttgtccacgcgcatcggctcgggctcgtcgccctccagccgttcctcgtagaggtcggtggccagcaccacctggatcttctggctcatgtagccgggggacaacgacagctcggtcaggtgttccaactgccgcgcgccaaaaccggcttcctccttgagctcacgttcggcggcggccagcacatcctcgccaggctcgatcaggcccttgggcagcgacagctcgtaggcgtcggtgccgccgcaatattcttcgaccaacaccgcatgatcggcatcgagcatcgccacgatcatcaccgcaccatagcccgcgcccttgcccaccaggcgctcgtaggtgcgctccacaccattggaaaagcgcaactgcaccgcttcgacgcaaaacagacggctggtggcgacgatctcgcgggcgagtacggtgggtttctggcgcataaaaggctccttggcgtgaacgcgctactataacgcggctttcccgattgtttgtgtcggatatctttctaccgttcgagacgttttccatgccttcactgccctggcgcgacatcgataccgttctgctggatatggacggtaccttgctggacctgcactacgacaaccacttctggatggagcacctgccccagcgctatgccgagctgcatggcgtcagccgcgccatggcggaaatggaattgcagccgctgttcgagcgtaacgccggacagttgcagtggtattgcctggacttctggagcgccgaactgaaattgccggtgcgcgaactgaagctggaaaccgcccacctgatcgccctgcgcccggacgccgatacctttctcgcggcgatcaggcaggctggcaaacgcgtggtgctgatcaccaatgcgcaccgcgattcgttgtcattgaagttggaaaaagtcgagctggcgccctatttcgaacgcttgatcagctctcacgattacggcttcgccaaggagaacccgcagttctgggatgcgttgcaagcggatatcggcttcgatccggcacgtagcctgtttatcgacgacaccctgccaatcctgcgcagcgcgcgggatttcggcgtggctcatctattggcggtgagtgaaccggacagccgcaaggggccgaaggacacggcggagtttgccgcggtgggggattatcgagcattgatcgaggggctgtagagcaatcctgtagccgctgccccaggctgcgatcgaccgtgaaacggtcgtagcgatgttgatcgccaaaggtccttcggaccttatcgcagccttcggcagcggctacagaccgagcattactcgggaatgcgcagtacctggcccggatagatcttgtccgggtgcgacagcagcggcttgttggcctcgaagatcttgttgtacttgttggcgtcgccgtacacggccttggaaatggcgctgagggtgtcgccttttttcacggtgacgaaacgtgcggcggcagccacaggaccggtgacggtgatctggtcgtcgacgctgccgacaccttcgatgttgcccacggccagcagaatcttttccttctcttcctggctggccacttcaccggtcacgatgaccttgtcgccttccacggtagcctggacgttggggttacccaggccgaccttggcgatgtgctccttcagctgttcgctcgcattggcgttacccggcgtcaacaaatcaataagcttttcgcccgcttctttcacaaagctaaaaatactcatggtgcacactccttgggtttaataggtccagacgcgaaagactagaccagccttgagagacgaggttcaaaatcgaccaatgactctctgcacggcaagcacgctagaatcgcctccccccgcgcccaggaagcgaagatggacatcaagcagctgaaattcctcatcgctctcgacgaaacccgccactttggccaggccgccgcgcgctgtcacatcacgcagccgaccctgtccatgcgcctgcgcaacctcgaggaagaactcgagctgtcgctggtcaaccgcggccagcgtttcgaggggttcaccgctccgggggaacgggtgctggcctgggcccgcagcgtgctggccgcctacgacgggctgcaagccgaggcggccgcttgtcgcggcaatctggtcggtaccctgcgcctgggggtggtgccgctgtcgagcttcgacccgctgccactgatgcagcgcctgcaccaggcgcacccgaatgtgcgcttcgagttgtcggcgctcagttccgagcagatcctcgaacagctggcgagcaatcgcctggatatcggtgtttcctacctggagcgcctggacagcgaacgcttcgaagccctggccctgggcgaaacccgcatgggcctgctctacgaccaacgctttttcagcttcggcgagcagcccctgagttgggaggcggtgatcgaactgccgctgggcatgctgaccagcggcatgcattttcgccagtccatcgaccataacttccacagtcgcggcctcactccacaaccgctgctgcagaccgatgccgtgcatcaattgctgcaagccgtacatggcggcctgtgctgcgcgatcatgccgctggacggcggtctggaagccctcaccgagcacctgcgcctgcagcccatagcagacgccaacaccctggcgcacctgggcctgatcatgcgccgcagcgcaccgcgctcggccctggccgaggcgtgcttcgccctgcagcagaaatcaccgagcgagtcttgatcgacggcatctatcggcacatcagtactagcaattagacgcgacactttgacgcgcttagtcttagggctggatattccgccggtgatgccccatgaaaccccagcgcccggcttgcgcgacgcccactgcgaaaacgcccgcgcccgccgccagtcagaactattgctacagcaacctcgaccacacggaatcggccagcaccgcgctcgccgaggaagtcgcgctggcgatcgcctataacggcatcagccaggccgtgatgctggtcacccccagcgacctggaagacttcatcgtcggcttcagcctcggcagcggcatcatcggcgacgcctcggacatctacgacctgcaactgagcggcagcggttcggcccagtacgcccaggtgcagatctccagccgcgccttctggaacctcaagcaacaacgccggcaactggccggtaccagcggttgcggcctgtgcggcgtggaagccgtggagcaggccctgccggacctcaaggtgctgcccggcgcgccattgccgcccgcccaatggctcgatggcctgcgccagcgcatcagcgccttccagcccctgggccagcactccggcgcggtgcatgcggcggtgttcatgaacgcccagggcgagctgctgctggggcgcgaagatatcggccggcacaacgccctggacaagctgattggcgcgttgatccgccagaacatacctactgccggcggcgtggccatcgtcaccagccggtgcagcctggaactgatccagaaagtcctgcgtgccggcatccagaccctggtcagtctgtcggcgcccaccggcctggccctgcaatgggcacgccggcacaacctcaacctcattcacctgccgcaaaaaagtgcgccacgggtctatagccctgcgatggagaaaccagcgtgaccactcatcaccaagccgaccagacacccaccccgcgctacaagccctacaagggcccggccggcggctggggcgcgctcatcagcgtcgcccaggcctggctgacgagtgacaacgccctgaaaaacctgcgcatgatgctcaagaccaaccagaacggcggtttcgactgcccgggctgcgcctggggcgactcgccggaaagcggcatggtcaagttctgcgagaacggcgccaaggcggtgaactgggaggccaccaaacgccgcgtggacggcaagttcttcgccaagcacagcgtcagctcgctgctggagcagagcgactactggctcgaataccagggccgcctgaccgagcccctgagctacgacgccgaaaccgatcgctataagcccatcagctgggaagccgccttcgccctgatcggcaaacacctgcgggcactgcccagcccggacatggccgagttctacacctcgggccgcgccagcaacgaagcggcgtacctgtaccagctgttcgtgcgcgcctacggcaccaacaacttccccgactgctcgaacatgtgccacgaagccagcggcgtggccctggcgcaaagcgtcggcgtcggcaaaggcaccgtgaccttcgacgacttcgagcatgccgatgcgattttcgtctggggccagaaccccggcaccaaccaccctcggatgctcgagccgctgcgcgaagcggtgaaacgcggggcccaggtggtgtgcatcaacccgctgaaagaacgcggcctggaacgcttccagcatccgcagcacccgatcgaaatgctcaccaacggcaacaagccgaccaacaccgcctacttccgcccggccctgggcggcgacatggcggtggtgcgaggcatggccaagttcctcctgcaatgggaacgcgacgcccagaagactggcgcgccggcggtgttcgatcacgacttcctcaacgaacacaccgccgccgtgctggattacctgagcgtcatcgacgacaccccatgggacgacatcgtcgaacagtccggcctgaccctggtggagatcgagcgcgcggcgcgcatgtacgccaagggcaagaacgtgatcatgtgctgggccatgggcatcacccagcatcgccactcggtgccgaccatccaggaaatcgccaacctgatgctgctgcgcggcaatatcggccgtccgggcgccggcctgtgcccggtgcgcggccacagcaacgtgcagggcgaccgcaccatgggcatcaacgaacagccgccagtggccttcctcgacgccctggagcggcgcttccagttcaaggtgccacgcgagaacggccataacgtggtcgaggcgatccacgccatgctcgaaggccgttcgacagtcttcatcggcctgggcggcaacttcgcccaagccaccccggacagcccgcggaccttccaggccctgcgcaattgcgacctgaccgtgcagatcagcaccaagctcaaccgcagccacctggcccatggcaaggaagcactgatcctgccgtgcctgggccgtaccgacatcgacctgcagagcgaaggcgcgcaagcggtgaccgtggaagactccttcagcatggtccacgcctccaacggccaattgcagccgctgtcgccacagatgcgttcggagccgtcgatcctcgccggcatcgccgccgccaccctgggcagccatccggtggactggaactggctggtggccgactacagccgtatccgcgacctgatcgccgataccattcccggcttcaaggacttcaaccagcgagtgaagaaccctggtggcttctacctcggcaactcggccggcgcgcggcgctggaacaccccgtcgggccgcgccaatttccgcccgaacctgctgcccaaggatctggtgcacgaacgcacccgcgccaccgggcagttgccggacctgatcatgcagtcgatgcgctcccacgatcagtacaacaccaccatctacggcctggacgaccgctaccgtggcgtgaagggccagcgcgacgtgctattcgtcaacgaagccgacatcatccgcctgggcttcaagccagggcagaaagccgacatcgtgtcgttgtgggatgacggccgcgagcgtcgggtcaagggtttcaccctgctggccttcgatattccggctgggcaggccgcggcctattacccagaggtaaacccgctggtgccgctggaaagcatcggggagggcagctacaccccgacctcgaagttcgtcgcgatccgcctggaagcggccagcgacagcggcttgatcatggcccggtcggcctgatcgacgaaatcgctggccctgtagccgctgccgcaggctgcgataaggcgcgcagcgccttccagggccctcaagagcaacatctcctacggagccgatcgcagcctgcggcagcggctacagtcaggaggttccagcggcggcgaaatcgcaggcacaaaaaaggccgcttccatccagaagcggccttttccaagtagctacagactcgcaaaaacgggataagttccctactaaaaacaataagttacgagattgtgtacaactcgtgctattcgtcggatttcgattgtaagcgcctcaacacaacctcaggatcgcgccgtcatccctttgaggctcctctatgaagttctcctcgattctcttgttgtcccttggcctggtcagcggcgtcgcctctgccggcggcaccacagaagcaggtgtgggcggcgcattgggcggggttctaggctcggtcgtcggtcagtcgattggtggcacaccggttccaccatcggtgccgcattgggcggcgcgggcggcagtgccgtgggtgccgacagacgcagccgtggcgaagccgctatcggtggcgcgctgggcgcagccggcggtaacgtggtcggtcgcagcgtggggggcaccactggcagcctgatcggcgcagccgcgggcggtggcgtcggcggcgcactgggtaaccatatgggcaactccagcgatcgtgacgatcgccgttaccgcgatcgcgactacgacgaccgtcgctactaccgcgacggccatccaggtcgtggccatgcctacgggcatcgcaagcacaaacgtcactggcgcgactaagacctgaaacggtcgcaacccgctgacacaaagaccgcagcctgacggcagctcctgccaaacagggttcatcacccccgggatgaaccccaaggagccgcccgaagcaggctgcggtcttttttgcgctttacaccagcaagcgttccagcgctgcacgcagcccggcgggaatccctaccggctgattcgatgcccgatcgacgaacacatgcacgaagcgccccgccgcgcaggcatcggtttcccccgccttgaacaccgccagctcgtactgcaccgaactgttgcccagcttgccgacgcgcagaccgatctcgatccgctcggggaaagcgatcgaggcaaagtaatcgcaggccgaactcaccacgaagcccaccacctcgccgtcatggatatccaggccgccctcctcgatcaggtaggtgttcaccgccgtgtcgaagaagctgtagtaggtgacgttattcacatgaccgtacacatcgttgtcgtgccagcgcgtgatgatgggctggaagtggcggtagtcggtgcgttgcggcatgcggtcggtcattggcgggttctcgaaggcgaggtgtctggaagacgaccatgatggggtcgatctggcgacgcctatttcaaccgatggcccggtgatcggcaaaccctttgccagcctgcgccagctcgtcaatcaaccgcgccggcttccagtgcgcgcccgattcggcttgcagccgcagcagcccctgccggatggataccaacccctgccgatccgcccagctcatcggcccgcccttgtccgccggaaagccataaccgttgaggtacaccaggtcgatgtcgtgggccgagccggcaatgccttcctcgagaatcttcgcgccttcgttgaccagcgccagcaggcagcgctcgaggatttcctcgggaccgatgtcgcgacgacggtagcccaggccttcgctgacttcctgaaccagggcatcgacctgcacatcgtgctcggcctgacggctgccgggctcgtagtggtaataacccttgccactcttctggccaaaacgacccgcctcgcacaggcgattatccacctgcacttcgtgcgcctcctggcctttgccggccagctgccgggcgcgccattccaggtcgatgccgaccacgtcgtacatgcggaacgggcccatggcaaaaccgaaaccctgcaatgcggcatccacctgataagggaaagccccttccagcaacatcttgcgcgcctccagcacataggtgcgcaacatgcggttgccgatgaatccagggcagttgccggacaccacactgaccttgcccatacgctcgcccagtgccagcgcggcctcgagcacctgcggcgcagtcgcggcgccgcgcacgatttccagcagcttcatgatgtgggccgggctgaagaagtgcaggcccagcacctgtcttgggcgccgggtgactgcggcgatggcgtcgatatccagcgccgaggtattgctggcgaggatcgcccgcggctggagcaggccatcgagttcgcggaagatttgctgctttagctcgaggttctcgtagatcgcctcgatcaccagatccacatcgcggatcgccggataatccgccgccgcgcttatccgggcccggcgcgcaccggcctctgcctgatcgatccgcccctgacgcacgttgtgtgcataagtctcggtcaccgctgtcagcgcctgttcgagcatctgcggattgttgtccacccactgcaccgcgaccccagcattggccaggcacatcacgatcccgcggcccatggtcccggcaccgatcaccgcggcgcgctgaatatcgatctggctcatagtggctcccctgtaggtggctcaaagacgcaaaccaccataatcaggcccagggcatttttgaaatttattcctgtgatgagcggcattcagcagatggatcgggcaggtatcaatcctggaggtgatgttcggcccaatcgcgcacttcggcgtagggataatcctcgagcaccgcgaaacccgggatcgaccgcgccttgagtttggtgaacagcggcacgctgatcccacagagaaagcgcgtcagccgttccgcccctggaaccgtgccgctgtattggtggtgcctgtggataaattcgccacacagcgcttcgaagtttttatccacaagcgcgggcaaggctggcggctccggcaggcgggccacctggccatggcataccgagcaatgcccgcaccgctgcggtgcctggtcgtcgccgaaatactgcgccaggcgataccccaggcactgctcggtggcgaacagtgcgagcatcgcgtggatccgcgcgatctcgctgctttcgtgctgtttgaagtaggcatgtagttgctggctcagggtcgcggcatcgaagcccgtctccagcaggttgtagacctcggtcatctgcttgctttccagctcgacccagcccttttcctggaagtagtccagggccttcaccacccggttacgctcggcctgatgctgctgatacagcgcgtcgaaattcaccgtggcccaggttcgggcacggctggaggtctcgatgatcgccgccacgaagtcgcggcgttcaccttcgaaacgcgccagcagcgcctgcggttcctcaaggaacttgaagcggtattcggcgaagtaggcgtaacgcggcgcgatcaggccgcgcagttccagctgcaccagcaaggtcttgagcggcagctggcgaatgttgctctggtccgccagcggccccagcaggaattcccattgcccgtcaggcgcggcgccctgcaactcgtccagcacacaacgaatgccttccagctccggcgtgtcgccgtagacgaagttttccagcacgttgaggctgtcgcggttggccagcaccaggcagtccgaaggctggccatcacgcccggcacggccaatttcctggctgtagttctcgatggatttgggcaggtcgaaatgcaccacattgcggatgtcgctcttgtcgatgcccatgccgaaagcgatggtggcgacgatgcaattggactggcccgccatgaactgacgctggatggcctcgcgctgctcatggggcagaccggcgtgataagcctgggcctgaatgccgttgcgactcagatgctcggcaatgtgctcggcggttttctgcaaggtgacatagacgatgctcggctgcccgggacgctcgctcatccactgcaccaggcgccggcgcttgtcctggccgcgcactggctccaccagcaggttgaggttgggccggtagaaaccggtagtcaccacatcctgcccggcgatggcgaatttcgcctgcatgtcggcgatcaccttgggcgtggcggtagcggtcagcagcagtgcctggggaatattgaactggcgctggtagtccggcagcttgaggtagtcggggcgaaagttatggccccattcggagatgcagtgcgcctcgtccaccaccagcagggagatccgcacctgctgcaggaagttgcgaaaacgctcgttcttcaggcgctccaccgagatcatcaggatcttcagctcaccggagcgcgcccgcgccatgacctcgttggcgtcgtcgcggctctgcgccgaatcgatgctcgccgcggcgatgccgtggcgctgcaggaacgccagttggtcctgcatcagcgccagcaacggcgagaccaccagggtcaggtgcggcagcagcaaggccggcagctggtagcacagcgacttgccggagcccgtgggaaagatcgccgccgccgagcgcccggccagcacggcgctgaccgccgcctcctggccgggacggaactgtggataaccgaagacctgttcgagggtgttgtgcatgagctgtcactcctttgaccgctgacgtgccttgaagcctagcgcggccagtcagcgggtcgagaaaaggtcgggaggaaaaggatacgggatgatacagggggacggagaacggcgttcggctggggatgacgcggagtttttcagggtgtatcgcaagccatcgggcaccggtcgatgcgcgatggctcgcgatagaaatcgtgctcttagcgcgtcgcgcggcaatccacccacttcacgccattgctcttgttcgcggcgatcagcgccggcactgcggcaggcgccttgttgtgaatgtcgtggaacagaatgatcccccggcgccacagcagcatcagcgtctgcacccgctggctcgccgcgctggcgctgatgctcttgctccagtcctgggagtcgacgccccagagcattaccttgatgccctgagccttgaagaacgccgggctgtcgctcgaacgctggccataaggcggacggaacagcggctggtagtcatccggcaaggtgccacgcaccagggtcgcggaacgggtgatggactgctgccattcgctccaggcgctgtgggacttgtgcgcccagccatgcagggcaacgcactgaccgctgtacaactcgcgcatttgcgccggcgaagacttgcgcagacgtgcctggaacggctcgcccaggacgaagaacaatccgtgcaggtcattggcccgcagcacgttggccagcgtatcggtgtggccacccgcggccgtcgggccgtcgtcaaaggtcagtagaaactgccgatccgccaattcgtcgcccatcagctcggcgctgtcgaaacgctcgatctcactgctgatcttcgggaacaacgccgccaggcgcagctgttcgttcagatactgctcatgaaactggcggctcgcctgggcccaggcgtcataggccgggctgaccgtcccggtgaagccctgggccagttgccgcaagtcatccaggttacgcaccggcgggcagaaggcggcaccttcacagtcctggctggcgctgtggtaactgctgagcaggcgtatccagaagcgatcgcgcacttgctcgaccgaatgatggtccagcgccttgacgcccaggcgctgcttgaggctcgcatcgtccagcgcctcgctggccagcaggaccttgccgaacatcaggatttccgcgcgcgaggcggtatcgaagcccgcttgcgtggccagcgaacccggccaggtgctgcggtcgatagtggcgaacaccatcgggccggcagcctgggaaacggccgtccacagggacaacatcaatgcaacaaccagaacccgcataacaacctccataaatgcataacgcgccgtgggacggcgcgttatgggggtcagatcaacacccgtgaatcaacggttttgcacacgctcgatggctttgtcgtacaccgggttggccttctgctgcttggccaactgatagtgacgcagcgcatcggcgaactggccggccgcttcgtagatccgcgcgatgttgtagtaggaactggcgcgcacggtggccgccgagttgccgctggccagggcgatagccttgcggttggcccagatcgactcggcagtgttgccggctttctgataggccaggccgaggttgctgtaggcctgaccgtagccgttgttcagctcgatggcctgacggtagaagtcgatggcttgctgcaggttaccggcgtggtaagcctcttcgcccttgcggttcagggttttcgcatcggcttgcgcgctgctgctgacggcgacagcagccacttccactttgtcgtcgagcagcggcgatacttcgttcagcacgtcctgcgcatcgacggtcacgccgctgagggtgttgatgtcctggaagtcgccattgccggtcatgcggaacacggtccacaggttaccgctgcggtcctgcggcacgtagtaggtgcgcaccagcgactggcccatgtacacgaacaccttggcctggctggcagagagctggcgggacgccgggcggccctggttgctgtagtcatgcaccgcgtacacatagctttcgccgtagtgtttcttttccagggtgatggtttccgggccgtagctgtcgacatcgtcgacgtccaggtgggcgtcatcgccttgctggttgcggaagtagatgttgttgcccgggaagatcatgtgcgaatcgagatcgctaggggtcgcgccccaggtcagcaccacgcgcagaccgtcgaggttctgcatcaccgggctgatggcgtaggtcatgccgctgcacgggcacttgaccaccaggttggaatagccgggtttcttgatgatcagcaggttgctggggtcatcggcaaagtcggtggtcagggtcacctggccttgagcattggtacgaccaaccacgctctgtgcgccattgcgctgcaccagcacttcggcgtcggcgatcttctggtccttgaccaccgcactcagcacctcgaccggcagctgctgcgccgtcaccgaaaacgccaatgcccacaacgaaaaaatcgaagtcacgcgaaacaatcgcatacctaattccctttaagtgtatgaagtcggcacccaaaggtacccggcagatttcgcgcgcacgatacacagttttttcgggatttgcttgctaatccattgggaaagatgggggctgcgggaacccctgaagtttgctgaggggccgggatggcaaaaccttttcagacagatttgaaaccgggcaaaccattagccgctcgccactccttcactatccgtgtgatgccttcggacgagtcatcggcaccattaccattctctgggtaaaaaatcagatcggagcctgctgggtgttcgctcaccttttcgaaatggaatacaagcgcattcactttttggggcgtcataggtgaacgtccaacagctctcaagaaccattacttccatctgatgacgctagatagagatccatcccttcaggaaaactcactgaacacaattgctcaatttcaacaatctgagcagccgttaatcgaaagtcggcaccaatacagtcactggctcctgtccaccccatgactggagccagttcgtcgacagacacattaatagatacttcaaatgtcagttcatcctttccaggctcaaagcccatcaccaagaacatcatggttctactctccttcccttatctgcatcttttgtttgcttacctgtaacgtaatcaaactcgccttgatgccttccgcgtttgttgtatttctcaagagcgccatgctgacgatcccactcataaatattacccgccctatcaacccaacgcggacgtagtccaccacctccggttacaggcgtcttggatcggcctcgcacagcatcagggaaagccgggagcaaaccttgaggggtaggatgatatttatgatcagaaacactcaacaccacatacagcggctgaacacctgaccccagcgggaacaccagaataaaatcccgatactccggcggataaatcggactcacgatgatccgctcagccgcttcagtcggcggaaaaatccagatcggaggcgtctgtggcgccgcttccagcggtggtatccctatggtgctcgaagggtccacagccgggatccaggtgagggtgatgccatcgcccaggccggccacttgctgctcgccacgggcctcgaactgagccaccggaatcatttcccactcgcggcgcccctgggtgttgaagccgtagcccttgagactgccatcggcctgctgttcaactcgcaggcgtagccgggtgcgagcttgcttgagattgcgtagctgctcttcgctgtacagcgcgccgtcacccaggctcgatggggcgagcaaggccaccagccccagcaacgcaccggccgccacgcccgaggagatcagccccaggccactgccagtggtaccagccgccgcggagacaccacccagggtcaaggtaccgagattggccggcagcgcgccgctgatgcgcttgagggccactcccccacccgcctcgacctcacgaccgcccagcagcgtcaacgcgccgtaattcgccaccgaatcagtaggtatgaagcctgtcggggtgacgtagtcgatgattgcgttcggcagcttgcaagacttggtgaacacacaaccgacgggcgttggttgcgattccacccgtgtagtcggcaaccgctcttcataggcctgctggcgagcgagcatctgctcgtaaccctgctgcgcctcatcacgctcggccaattcgctcgcagtcatatcgcgcaggcgacgataaccaccgccgtcagcgtcgtagtgctgccatacctggggcacatccttgttgcgggccatagtcctttgctcggtcgcctgggaaaccccagccttcaaccgggggatctcacgttaaccagtgcgaggggaccttggctgtcaggcaaatccgagctggtcgagcgacttttctttttcgttcatgccctgcgattggccctaaacggtctacgacaggacacaaggatttaccttacaagtcacgtcgaatccggcttattgagtcgcgcggacaagccgcctagtgtttgaacaggactgaatgacgctcacaaaaaagccgccccgaagggcggcttcttgaaccacttgcccgatgcttacagcttcggaccagcagccttgatggcgtcgctcacgtcgaacttcttgaagttctcgatgaacaggccggccagggccttggcggcttcgtcgtaggcggctttgtcagcccaggtgttgcgtgggttgagcaggccggtttcgacgcctggaacggccaatggcacgtccaggttgatggtgtccaggtgctcggtctcggcaccgaccagggcgccgctctggatggcggcgatcacgccacgggtggtcgggatgttgaagcgcttgccaacgccgtagccaccgccggtccagccggtgttgaccaggtagaccttggagccgaagccgcggatgcgcttgatcagcagctctgcgtaaacgcctgccggacgcgggaagaacggtgcgccgaagcaggtggagaatgtggacttgatgccagcgcccgaacccatttcggtcgagcccaccagagcggtgtagccggacaggaagtggtaggcagcttgttcttcgctgaggatcgagactggcggcagtacgccggtcaggtcgcaggtcaggaagatcacagcgttcggttcgccaccgaggtttttctcggaacgcttctcgacgtgctccagcgggtaggcggcgcggctgttctgggtcaggctgccgtcggcgtagtcagccttcttggcgtcgtccagcacaacgttttccagcacggcgccatgcttgatggctttccagatgaccggctcgttcttctcggacaggtcgatgcacttggcatagcaaccgccttcgatgttgaacactacgccctcgccccagccgtgttcgtcgtcaccgatcaggtaacggctctcatcggcggacagggtggtcttgccggtgccggacaagccgaagaacagggttacatcgccttcttcgccgatgttggcggcgcagtgcatcggcagcacgtcggcggccggcagcaggaagttctgtaccgagaacatggctttcttcatttcaccggcgtagcgcatgccggcgatcagcacttttttctgagcgaagttgaggatcacgcaaccgtcggagttggtgccgtcacgctcaggaacgcattcgaagttggcaacgttgagcacctgccactcgtcacggccagccgggttgtactgggccggattgatgaacaggcaacgaccgaacaggttctgccaggcagtctgggtggtcatcttcacggccaggtagtgctcgtcggaagcacctacatgcacatgggaaacaaaatgctcttgcgcgttgttgaacgcctcgacgcgagcccacagggcatcgaacttgtcggccgggaacttgcggttgatcgggccccaggcgatagcgtcctgggtgctcggctcttcaacgatgaaacgatcgactggcgaacggccggtacggtgaccggtacgaacaaccagcgcgccggtatcggcaagctcgccttcaccgcgcttcagggcttctttgaccagatcatcaacactcagatcggtgtacacggcgttattggcttgcgtcatgaggttccccgtcggccagtggccgagtgctccaaacgttttgtagtagaaagtcgtgcactactaccgcgaaaaaagtgcgccggattatgccagaaaagcccaaaaagagtagggccctcccgtcagaacggcgttaatccggcgcttgccaggtgatttacctgcgctgaaccgttttagtgacgagtatctgacggcgactcgacacctgctccggcgaacaattggctgatatcggccgcatcgaacaggtagcgctcgttgcagaactggcaatcgatctcgatgctgccgccgtgttcgaccaccagcttctgcgcatcttccagacccagactgaccagtgcattgcccgagcgttcccgcgagcagctgcaacggaagcgcagcggctgcacatcgaacaggcgcacggcttcttcatggtagaggcgatggagcacggtttcgttgtccaggctcagcagttcgtcggcggtcagggtgctgcccagcgcggtgatgtgctgccagctggcggcgcgctcttcttcatccttgaggcggtcggccggcagttgctgcaacagcaggccacgggcgcgacgaccgtcggcatgcaaccagaaacgggtaccgacctgctgggacatgacgaaatagttggtgaagcattccgacagggtggcgccatccaggtcgacgatgccctggtagcgctggccgtgagtcgggtcgacggtcagggccagcacgccattgggcatcaggtcggccagggtcgcatccggggcgatctgctccgcgtcgtagcgggccagaccacggatctcgcgctcgctggagcactcgatcatcagcaatggcaccgggccttcggaacgggcctggaggatcagcaagccatcgaacttcagcgtgccgaccagcagcgcggccgccgccatcagctcgccgagcagttgcgcgaccggctccgggtaagcgtgtttggcgaggacttcggcatagctgcgctccaacgccaccagctcgccgcgggcgtcgctgtcatcgaagatgaagcgttgggtgaagtcggtatccggcaaatgagtcataggtttgggtatctgaggtgatgacaaaatagttacaagatatgaaaattgcgttttttgcactgttacggtgcgcgattttctgccattggaggcattttatgaacaatccgggtttgttccaagcaaggtggaacctcggcaagctggtgttgtgcaatttgctccctctggcgctgctgggtttctggttatggccaagcgggcacatgctttgtgtgatgttcgacgaatggctgttccacctgctgaatgctccccttgcgagcaactccacctggctgcatatctgggccgtggccagcctgcggcctttcgacgcgatagtcgggctgatcctgctgacccttttgatccgcggtgactgggtgttcaaggccgtggacgtgcgccgggcctttttcggcttcctgtcgatcctggtcttgatgctgattatccgcttgttgttctccaggctcgccgacgccatgggctggcagcacgacagcccgtcgatgatgctccaggatgccgtgcacatgagcgactatttcccgcactgggaaaaaacctgggagctcaaggaccgttccagccagagcttccccggtgaccacgcctcggtgctgctgatctgggcgctgttcatgagtgtgttcagccgcggcgtcggccaattcctggtgatctggggcctgaccctgctgttcatgatgccgcgcctggtggccggcgcgcactggggccaggacgattatatcggtggcgtgctgcttgcagtctgggcactcggctggggctactacagcccgtacgcggccaaggcctcagacttcctgctgcgggcgaccaacccgctgttcaatctgctgggcaagctgccgttgctgtcgcgcctgagcgtggtgcgggcggcctgactcttcggatttgctgcttgtcgcggctttgccgcggatcgcgagcaagctcgctcctacaggggttgagcggtgcgccggctgtgtaggagccagcttgctggcgattgaacccgcagggttcagaaggccaagggtctattcgctgctgcggaatttgaacaggtcgcgccgctgtttcttggtcggcttgccgtcggtgctcacacccagggcgccggccttgcgcagggccgcggcgttttcccgcttggcgatgctggcttcggtttccgtatagagagcctgtgcttgcggcgccccacgacgcacgatcgacagggcctggaccaccacggtgcgctcgtcgaagccggtgcgtatctcatactcgtcgccgatcctcggctccttgcccggtttgcagcgctcgccacggtggtgcaccttgccgctttcgatggcggccttggccagcgcacgggtcttgtagaagcgcgccgcccacagccatttgtccagacggaccttgtcgtcgtcttcggctttttgtgccatggcatgtcctcattctgaaatattttcgaactgtactaccgtttctctcgtgccatgaattgcgatggctcggtttagaatgcgaggctctgcagcagcccgtccgggcgctatggatccgggcctagatatctgtcgccttttacccattattctgcgtgaataccgcgaattcggccgcttgacggtacgagcgggttcctcagcggttgagcacatttgaagacatttgaccatttgaccgtcgtgggtctgcgcgagtgggtggcgcttccggatttgggagtcgccggcctgcgcgccaagatcgataccggcgccagcacctccagcctgcatgccaccgagatcgagccgttcgagcgcgacggtgagcagtgggtgcgcttcaacgcgcacctgggcagcgtggtgcagttgcgtcaccggcgttgcgaagcaccgctggtagcgatgaaaaccattaaaagctccaacggccaggcacaggtgcgctacgtgatcagcaccaccctggcgctcggcgatcgggtctggcgggtggagttcaccctcgcctgccgcaaggccatgcgctatcgcctgttgctcggttccaaagccctgatcgatggccagttggtggtcaatccagggatcaaatacgttcaagacaaaccggtgttcccggtgtccactacctctgccacaggtgttgcatgaagatcgctgtgctgtcgcgtaacccgcgtctgtattccactcgtcgcctggtcgaagccggcaccgagcgtggccatgaaatggtggtggtcgacaccctgcgcgcctatatgaacattgccagtcacaaaccgcagatccactaccgcggcaagccgctggagggtttcgatgcggtgattccacggatcggcgcctcggtgaccttctacggctgcgcggtgctgcgccagtttgaaatgatgggtgtgttcccgctcaacgagtcggtggccatcgcccgctcgcgggacaagctgcgctcgttgcaactgctgtcccggcgcggcatcggcctgccggtgaccggcttcgcccactcgccggacgacattcccgacctgatcgagatggtcaacggcgcgccgctggtgatcaaggtgctggaaggcacccagggcataggtgtggtgctgtgcgaaaccgccaccgcggccgagtcggtgatcgaggccttcatgggcctgaagcagaacatcatggtccaggagtacatcaaggaagccggcggcgccgacatccgctgcttcgtggtcggcgacaaggtgattgccgcgatgaaacgccaggccaagcccggcgagttccgctccaacctgcaccgtggcggcagcgccagcctgatcaagatcaccccggaagaacgcatgaccgccctgcgcgcggccaaggtcatgggcctgagcgtggcgggcgtggatatcctgcgctcgaaccacgggccgctggtgatggaagtgaattcctcgccaggcctggaaggcatcgagaccaccacgggcaagaacgtggcggggatcatcatcgagcacatcgagaaaaacggtggcccgaacatgacccggaccaagggcaagggataaaggcagcggcaagcttttagcggcaagctgcaagagaaaagcgactcctcacttgccgcttataacttgtagcttgccgcttgtagctgccttcagaccgcatccctgggcagcaacaatcccaacggcaagcgcacccgcgcttccaggccaccatcggcgcggttgcgcaattcgacattgccgccgtgcatcgaggcgatccgcttgacgatggccaggcccaggccggtgcccttgccaccccgggcacggtcgccgcgggtgaaggggttgaagatcgcttccagctccgacgggtcgatgcccgcgccacggtccatcacactcagcaccacataaggcgcgctggtgtcgcccgacacataggccgcgacttcgacttccgtcccagcgtggttcagggcgttgccgatcaggttgttcaacaggcgcttcatcgacacccgacgcagcgggaacggtgggatcggctccaggcgcaaacgcaccttttcatcgttctggttgtagggcgccgccacttcgcgcaccaggtcgctgagatcgacctcctccaccgattcgtcgcggccgtcgcggataaaggccaggaactggtcgagaatcgcgtccatgtcttcgatgtcgcgaaccatgtcgtcggtcaggtcgttgtggctgcccatcaactccagcgacaggcgcaggcgggtcagcggcgtgcgcaggtcgtgggacacccccgccagcatcagctcgcgttcgcgcccggcctgttccacgtcctcggccatctggttgaaggcgcggtacacctcggtcatctcgctcggcgtatcgctgatcggcaggcgcacgctgcgcccctgccccagttgccgggcggcatagaccaggcgcttgagcggctggttgagctggctgacgaagatccacgccgacgccgtagacaacaggccgatggccaggaaccagccgagcacgctccagatcttctgcccccgcagcgggtgcggatacagcggcactttcagccagccgtcgcccaggctcggcgcgcgcacccagagcgccggcggcgcatgcatgcgcaggcgcacttcggtgtcggcgcccagctcggcctgcatctgccgctgatagatctcgctgtagggccaatgctgctcgcccgccggcacaccgctgccgaccaccttgatcagcccggcggcctcggcgatctggtcgcggttggattcgtcggcggcccaataggcgcgcagggtcagggccacgccgtggctgtactggcggtccaccagcacgtcctcgttcatcagcagataaaccagggtcagcgccttggagaacagcaccacgatcagcaccagccagagggtgcgggagaagaagctttgcgggaaccacagcggggttttcataaacagccattacacgctttgcaggagcgagtcgcgctcgcagagttgcggaatgcgagcgcccgggtcgtttgccggcccgggtgctcgctcctacaaatcatcggtcacttggtggtggtgccatccggcacgaacacataacccacgccccagaccgtctggatataacgcggcttggacggatcgggttcgatcatccggcgcaggcgggagatctgcacgtcgatggaacgctccagggcatcccactcgcggccacgggccaggttcatcagtttgtcgcgggtcagcggctggcgagcgttcatcaccagggccttgagcaccgcgaactcaccggtggtgagcatgtgcacttcggcgccgcgcttgagttcgcgggtggccagggacagttcgtagtcgccgaaggtgacgttttcgtcttcgctgcccggcgcgcccggcaccggagccgactggcgacgcagcaccgccttgacccgcgccatcagctcgtcggggttgaacggcttggccaggtagtcgtcggcgcccagttccaggcccttgatgcggctcagctcgtcgcccttggcggtgagcatgatgatcgggatctggttgttcgcactgcgcaggcggcggcatgcggtcaggccgtcttcgccaggcagcatcaggtcgaggacgaccaggttgaagacttcgcgccccagcagacggtccatctgctcggtgttgggaaccgcgcgggcacggtagcccttgctgacgaagaagcgctccagcaggctgctcagcccggggtcgtcgtcaacgataagaattttttcgccttcggcagtttgtgcagtgctgctcatcagatgctccttttatctcggtgcgcattatggcgtagctgccgttatacgcaccgtgtgcattgttagcagatttttcctctaccgccagaaaacccgccgtcggccgccagtgggccgatacccccgaagactggaacgctggttataatgcgccgccttttgtgtcaggcaacgtctgatcgttaccgcccgtggccactttttatttttcccggccaggcagtaattgttcgatttcacgggtcaacaggcagccttttgatccaggcagcggcgcacgccaggccgctcaaccagactcgccgaggccaattttccgtgccggcgagcctgcttcacaatttgtcaggtggttttatggacagcatcaacagccgcattgcggaggaactcggcgtacgcccacaacaggtcgaagcggccgtcgctctattggatgaaggctccaccgtgcccttcatcgcccgctaccgtaaggaagtgaccggcagcctcgatgacacccagttgcgtcatctggaagagcgcctgcgctacctgcgagaactcgacgaacggcgcatcagcatcctcgccagcatcgaggagcaaggcaaactgaccccggaacttgcccgcgacatcaagctcgccgacaccaagacccgcctcgaagacctctacctgccgtacaagcagaagcgccgcaccaagggccagattgccctggaagccggcctcggcgaactggccgacggcctgttcaacgacccaagcctgaccccggaaagcgaagccgcgcgcttcgtcgacgcggaaaaaggcgtggccgatgtgaaggccgccctcgaaggcgccaagtacatcctcatggagcgcttcgccgaagacgccagcctgctggacaagctgcgcaactacctcaagcaggaagccaccctcagtgcccgcgtgatcgccggcaaggaagaggaaggcgccaagttccgcgattacttcgaacacgacgaaccgctcaagagcatgccgtcgcaccgcgccctggcgattttccgcggccgcaacgaaggcatcctcagctccgcgctgaaagtcggcgacgaactgcccggcaccatgcacccgtgcgaaggcatgatcggccagcacgtcggcatccagaaccagaaccgcccggccgacaaatggctcggcgaagtggtgcgctggacctggaaggtcaagctctacacccacctggaaaccgacctgctgggcgagctgcgcgacaacgccgaaaccgaggcgatcaacgtcttcgcccacaacctgcacgacctgctgctggccgctccggccggtccgcgcgcgaccctgggcctcgacccgggcctgcgtaccggctgcaaggtggcggtggtggacgccaccggcaagctgctggaccacgccaccgtttacccccacgtaccgcacaacaagtgggaccagaccatcgccgtgctggccgctctgtgcgccaagcactcggtggacctgatcgccatcggcaacggcaccgccagccgggaaaccgacaagctggccgccgagctgatcaagaaatacccggccatgcgcatgaccaaggtcatggtctccgaggccggcgcttcggtgtattcggcgtcggaactggccgccaaggaattccccgacctcgatgtgtcgatccgtggcgcggtgtccatcgcccgccgcctgcaggacccgctggccgagctggtgaagatcgatccgaaatccatcggcgtcggccagtaccagcacgacgtgtcgcagctgaagctggcccgtggcctggatgcggtggtcgaggactgtgtgaacgccgtcggcgtggacgtcaacaccgcgtccgtggccctgctggcgcggatctccggcctcaacaccaccctggcgcagaacatcgtcagccaccgcgatgaaaacggtgcgttcaagacccgcgccgcgctgaagaaggttgcccgcctgggtgaaaagaccttcgaacaggccgccggtttcctccgcgtgatgaacggcgataacccgctggacgcgtccgcggtgcacccggaagcctacccgctggtgcagcgcatcgccgccgagaccgaccgcgacatccgctcgctgatcggcgacagcggcttcctcaagcgcctggatccgaagaagttcaccgacgagaccttcggcctgccgaccgtcaccgacatcctccaggaactggacaagccgggccgcgacccgcgtcccgagttcaagaccgccgagttccaggaaggcgtcgaagacctcaaggacctgcaactggggatgatcctcgaaggcgtggtgaccaacgtcaccaatttcggtgccttcgtcgacatcggcgtgcaccaggacggcctggtgcacatctcggcgctgtcggagaaattcatcaaggacccgcgtgaagcggtgaaggccggcgacgtggtcaaggtcaaggtcatggaagtcgacattccacgcaaacgcgtcggcctgtcgatgcgcatgagcgacaccccgggcgagaagatcgacggcgctcgtggctcgcgcccaggctcggcgccacgctcgtcgggcaacagcgccccgcgcaaggaaagcgtggccgcggccccgaccaacaacgccatggcgtcgctgttcgccaacgccaagcagttgaagaaacgctgatggagatcccggccggcttgaccgaaagcgcgttcagccaactgatcggttgccgcctgcagcgtctggaagtcggtgcagccgacgtcgccctgacgctgacgccacagttgcgcaatcgtggccagaagctgcacggcggggcgatcttcagcctggtcgacattgccatggggctggcttgttccagctcccacggcttcgaccagcagagcgcgaccatcgagtgcaagatcaactacatccgcgccgtcgccgagggcgacgtgctctgccacgcccgggtgatccacccgggccgccgcaccctggtggtcgaggccgatgtgatgcaaggcgacaaactggtcgctaaagcacaaggcacgttcgctgttctatagcccctcaacctcgatttgagttaatttcggcgctgcacacacggcgccggatttttttgcgcgtgcaagagccagttcaaggatgaagcaatggcgttgcaaagcgggccggtaaggctcaacgaccaggcgaaaacgccagtttcaacttcacccttgtagaccgtcctgcccacccccatattggggcgactgacgcgtgaaggaatccaacttgagcgaacttctcaaccgccgcctggctctgctcggcgagcgcgctaacctctctctgctcgagcagtgcctgcacggtatcgagcgcgaatgcctgcgcgtgaccggcgaagcgcgcctggcacagaccccgcacccggaagaactgggttccgcgctgaccaacgaacagatcaccaccgattattccgagtcgctgctggagttcatcactccggccctggccgatccggctgacaccctggccagcctcgacaagattcaccgtttcgcctacagcaagctcggcaacgagtacctgtggagtccatcgatgccgtgcccgttgccggccgaggaagacatcccgatcgcctattacggcacctccaacatcggccagctcaagtatgtgtaccgcaagggcctggccctgcgttacggcaagaccatgcagtgcatcgccgggatccactacaacttctccctgccggagcagctctggccgctgctcaagcaggccgaaggcttcgtcggcagcgatcgcgactatcagtcgtcggcgtacatcgcgctgatccgtaacttccgccgctacagctggctgctgatgtacctgttcggcgcttcaccggcgctggacgcgggcttcttgcgcgggcgctcgcaccagctggaacaactggacgccgagaccctgtacctgccgtatgccaccagcctgcgcatgagcgacctgggctaccagagcaacgcccaggccggcctgaccccttgctacaacgacctgaacagctacaccgacagcctgcgcaaggccgtcgccacgccgtacgcgccttatgtggagatcggcacccaccaggacggcgagtgggtccagctcaacaccaacatcctgcagatcgaaaacgagtactactccaacatccgcccgaaacgcgtgacctacaccggcgagcggccgatccaggcgctgatggcccgtggcatccagtacgttgaagtgcgctgcctggacatcaacccgttcctgccgatgggcatcgacgtgcaggaggcccgcttcctcgacgccttcctgctgtattgcgcgctcaacgagagtccgctgctggaaaacaatgagtgcggcaacgccacctcgaacttcctcaaagtggtcaaggaaggacgtcgtccgggcctgcacctgctgcgccagggacaactggtggagctcaaggaatgggccggcgagctgctggaaaagatcgcgccgctggccgccctgctcgaccgcagccacggcagcgacgcccacagcaaggcactggacgcccagctggccaaggtcaaggattcgtccctgacgccttcggcccaggtcctggccgccatgcaggagcacaaggaaagcttcagccagttctccctgcgccagagcctggcccacgccgagttcttccgcagcgaacccctgagcaaggaagaccaggcacgtttcgaagaagccgcgcgcagctccctgctgcaacaggccgagctggaacgcaacgaagtcggtgatttcgacgtgtttgtcggttcgtaccaggcgagcatcctggcaatcagtaactgacacaccgcgccgcctgtatcgcgagcaagctcgctcctacacagtactgtcctgtaggagccagcttgctcgcgatggagcgcaaagcgctccccttcaaaaaagtgctctctttagaagattcctcttttaagctaattctaaaaagttatttatttttagattcttagatcatttagtctcctcccacgtccacacttggccgcccgtcgaggagcttcatgatgaaaatgcactttccccttcgccttctggcggccgtatccctggctaccgcgagcttgttcgcccaggcagccgatgtcaccgtcgcctaccagaccaccgtcgatccggcgaaagtcgcccaggccgacggcacctatgaaaaggccacccaggccaagatcgactggcgcaagttcgacaacggcgccgatatcatcgccgccatcgcctcgggtgacgtgcagatcggctacctcggttccagcccgctgaccgccgcgatcacccgcaaggtgccggtggaaaccttcctcattgccacccagatcggcgccgccgaggccctggtggcccgcgacggatccgggatcaacacgccccaggacctggtcggcaagaaagtcgccgtgcccttcgtttccaccggtcactacagcctgctggccgcgctcaagcactggaaaatcgacccggcgaaagtacagattctcaacctggcgccaccggcgatcatcgctgcctggaaacgcggcgacatcgacgccacctacgtctgggatccggcgctgggcgtggccaaggaaaacggcaaggtgctgatcacctccggcgaactggcccggttcggcgcgccgaccttcgacgcctggatcgtgcgcaaggacttcgccgagaagcacccgcaaatcgtcaccgccttcgccaaggtgaccctcgacgcctacgccgattaccgcaaggacccaaaggcctggctggcggagcagagcaacgtcgacaagctagtgaaactctccggcgccaaggccagcgacattccgctgctgttgcagggcaacgtctacccactggcggccgaccaggtcatcagccttggcgcgccgaccaccaaggccatcaccgataccgcggtgttcctcaaggaacagggcaaggtcgaggcggtactgccagattacgcgccatacgtcagcgccaagtacatcacccactgaaggtcagccgcagaggtcgccggcccaggcccggcgcttctcgtacaacgtctcacctcgacaaaggctgcatttgaacaaggagcgcgccgtcatggctttgctacaactggagcgcatcagcgcacagtaccccggcgccgccgaaccggtgctggcggatatttccctgacgctcgggccccagcagctgctggtcgccctcggcccttccggcagtggcaagacttcgctgttgaacctgatcgccggtttcgtcgaacccagcgccgggcgcatcaccctggacggcgtgccggtcgccggcccgagcgccgaacgcggcgtggtgttccaggacgatgccctgctgccctggcaggacgtgctggccaacgtcggcttcggcctcgaactggccggcattgcccgcgacccgcgcgaagcccgcgcccgggaaatgctcgcgctggtggacctggccggcttcgacaaacggcgcatctggcagctctccggcggacaacgccagcgtgtgggcctggcccgcgccctggccgccgacccacgggtgctgctgatggacgagcccttcggcgccctcgatgccttcacccgcgagcagatgcaggagctgttgctgcaagtctggcaacgcaccgccaagccggtgttcctgattacccacgacatcgaggaagcagtgttcctcgccaccgacctgatcctgctggcccccaacccggggcaaatcgtcgagcgcttgagcctggacttcggccagcgttacgcggccggcgaatcggcccgggcaatcaagtccgatccacgctttatcgaaacccgcgaacatgtgctggcccgggtgttctcccaacgcagtgccgtcttgcggcaggagcgcgcatgaacagctacgacctcccggccaccacgaccaaagccgctaacccgcacaccgcggtgccccagcgccgcagcctgagcacccgctggatcagcgtgctgaccctggtcgtgctgctcgccctgtggtgggcggtgacggccagcggcctgatcgaaccgctgttcctgccgccaccttccgccgtgctgcaaaagggctggctgctggtgaccagcggctatatggattccaccctgtggcagcacctgggcgcgagcctcggacgcatcggcctggccctgggttttgccgtgctgaccgcgattccggtgggcatcgccatcggccacaatcgcatcgcccgtggcgtgctggacccgctgatcgagttctaccggccgattccccccctggcctacctgccgctgatcgtcatctggtgcggcatcggcgagctgtccaaggtgctgctgatctacctggcgatcttcgccccgatcgccatcgccaccgccaccggcgtacgcaccgtcgacccgacccggctgcgcgccgcgcagtccctgggcgcgacccgggcccagctgattcgccatgtgatcctgcccagcgccctgccggacatcctcaccggcgtgcgcatcggcctcggggtgggctggtcgaccctggtcgccgccgaactgatcgccgccaccagcggcctggggttcatggtgcaatccgccgcgcagttcctggtcaccgatgtggtggtactggggatcctggtcatcgccctgatcgccttcgccatggaaatgggcctgcgcgccctgcagcgcaagctggtgccctggcacggccaggcccattgaaaccctgtatctgtagccctgtagccctgtagccctgtagccctgtagccctgtagccctgtagccctgtagccctgtagccctgtagccgctgccgagcgtagcgaggctgcgatcgagcgcaacgcgctcgcccaaagcctgcgcctgcttcgcaggcgatcgcagcctcgctacgctcggcagcggctacaagcggccacacctgaattcgagaacgacatgagcctgaccatcacccctttaagctccgccttgggcgcccagatcagcggcgtcgatatcagccaaccgctggccggcgaacagcgcgacatcatcgagcaggcgctgctccagcatcaggtgctgttcttccgcgaccagccgatcgacccgcagcaacaggcgcgcttcgcggcgaactttggcgacctgcatatccatccgatctaccccaacgtgccggaacagccggaagtgctgatcctcgacactgcgcaaaccgacgtgcgcgacaacgccatctggcacaccgacgtgaccttcctgccgaccccggccctgggcgcggtgctcagcgccaagctgttgccggcctacggtggcgataccctgtgggccagcggcatcgcagcctatgaggcgctctcggagccgatgaagaacctgctgcaaggcctgaccgcgacacacgagttcatcaagtccttccccctggaacgcttcggcaataccccgcaggacctggcgcgctgggaagaagccaagcggaaaaacccgccgctgtcgcatccggtgatccgcacccacccggtcagcgggcgcaagtcgctgttcgtcaacgaaggcttcaccaccaggatcaacgagctgtcggacagcgaaaacgaagtcatcctgaaactgctgttcgcccacgccacccgcccggaattcaccatccgctggcgctggcagatcaacgacgtggccttctgggacaaccgcgtgacccagcactacgcggtcgacgactaccgtccgcaacgccgcgtgatgcaccgcgcgacgattctcggggatgtgccgtttttccgataaccgatattcatgactgcaacaggactggcgggtgattgcggcgtcaccaaacgataagtggttgcccaccctcgatgacgcgcggctatgctatcaatgattgcattgatttcattcggaggaacccatggccagcctgacaatccgaaacctggacgaccacatcaaagagcgcctgcgcatcgaggccgcccacaacggccactccatggaagaagaagcccgcttgattttgcgccgcgccctgaacagaacaaccgacagccaaggcctggccagtcgtatccgggcacgctttgccgaggccggcggagtgaagcttgagctgcccgaacgtaccgagccggcacgcgtggtggatctgggcgaatgatcgtgctcgacactaatgtgctgtcggaactgatgcgtccccaaccggacgcatcggtattgctgtggatcgaagcgcaacctgtcgaagacctctacatcagcgccatgaccatggccgagattcttcacggcatcgcgcgcctgcctcacggcaagcgcaaacagatgctccatgcgtcggcgctggcgatgttcgaggaagacttcatcgaccgcatcgtgcccttcgggacccaggcggctctttactacgcccatctgatttcgcaccgggaaagcctggggcgtccgatcagcttggtggatgcgcaaatcgcggccatatgccgcgtccacgacgcggcgatcgccacccgtaacgccaaggatttcagcgatacagggttgatcgttatcaacccctggctgccactcgaggtttgaacccggctctgtaggagcgcagcttgctcgcgatagcgggatgcctgacagcacatgccctctggatcgccggcaagcctggctcctacagaagccgcggcagccttacaacatgacggcaggttctattccgcggttgaaggcttctcccacagattgatcccgccttcgcgggcaaaacgatcgatctctgccagctcttcggcgctgaagttcaggttctgcaatgcgccgacgttctcgacgatctgctccggccggctggcgccgatcagggccgaggtcacccgtgggtcgcgcagagtccaggccagggccagttgcgccaggctctggccacgacgctgggcgatttcgttgagggcgcgcacatgggcgaggttggcctcggacaggtgcgaggcttgcaacgaaccaccgcccgggcggttgacccgcgcatcctcgggaatgccattgaggtacttgtcggtcagcaggccctgggccaacggcgtgaaggcaatcaccccggcgccgagttcttcggtggtgtccaaaaggtccttttccacccagcggttgagcaggttataggccggctggtggatcagtagcggcactttccattccttgagcaaggctgcgatctcacgggtcttcacccccgaataagacgagataccgatgtacagcgccttgccctgctgcaccgcggtggccagggcgctggcggtttcttccaacggggtgtccgggtcgaagcggtgggaatagaagatatccacatagtcgaggcccaggcgctgcaggctctggtcgaggctggccagcacgtatttgcgcgagccgccgccctggccatacggaccgggccacatatcccaaccggccttgctggagatgatcagctcgtcgcgataccgcctgaagtcttcacgcaacagacgaccgaaattgatctcggcgctgccatagggcgggccgtagttgttggccaggtcgaagtggttgatgcccaggtcgaaggcggtgcgcagcaacgaacgctgggtgtcgatcggcgtactgtcgccgaagttgtgccacaggcccagggacagcgccggcagcaccaggccgctgcgtccgacgcggcggtaggggatggagtcgtagcggttttcggcagcaaggtaagtcatcgaatcctctctcattggcgggactgcgctgtggtttgaagccttcgggtttcacgatcgaccgcaccgcggtcgcctgcctctctatgcaaattgattcttcggtcgcgccagccccaggttctcgcgcaacgtcttgccctcgtattcggtcctgaacaacccgcgtcgttgcagttccggtaccacggcgccggcaaagtcctggagcccgcccggcaggtgcggcaccagcacgttgaagccatccgccgcgccctcctcgaaccagccttgcagctcgtcggcgatctgcgccggcgtgccgatcaggctgtaatgcccccggcccccggcgattttccggcccagctcggccaggctcaggttgtccttgccggccagttccaccagcagcttctgccggctttgctggccgctttcggtcaatggcagcgcgggcagcgggccgtccagcgggtactgcgacaggtcgaagttgcccagcatacgcccaagcagggcgacgccaacctcgggttcgacccattgctgaaacgattcatatttttcccgggcctcactttcgctctgccccaccaccacgaataccccgggcatgactttcaatgaatcggcgccgcgtccgtagcgggccaggcgccccttgaggtcggcataaaacgcctgggcgctggccagtgaggtctgggcggtaaataccacctcggcggtctgcgccgccagctcgcgtccggcttcggaggaaccggcctggacgatcaccggatagccctggggcgggcgcgccacattcagcgggcccttgacccggaagtgctcgccctggtggtccagcacatgcagcttggccgggtcgtagtactggccgctgcttttgtcgcggacaaaggcgtcgtcctgccaactgtcccaaagcccggtgaccactgcatggaactcgcgggcgcggctgtaacgctcggcatggcccaaatgctcgtcgcgaccgaaattctgcgcttcggccgcattgtcggaagtcaccagattccaacctgcccttccacccgacaggtgatccagcgaagcgtacttacgtgccacatggtacggtacgttatagctcgtagtgctagtggcaattagcccaatatgctcggtcacgacgctgagggcagccagcaaagtcaagggttcaaactgctccgaacgcgccattctgtgggcctcggggcccgttgcggcggccacgctgtcagccaggaacagggcatcgaacttcgctgcctcggcgatccgggccagctgcctgtacgcagaaaagtctagtccggcattcgccggtacgtacggatgccgccaggcggcaacgtgatgaccggtggccatcaggaaggcgccgagcttgagttgtcttgggtgggtcatggccttttccttgaagcggtcattgagggtcgttgcacgcaacggctcaaaaatccttgcgcacctgtaccccgaaataacgttcgtcatcccgtggcacggcgcggtagatgtaattgccgccactggccagcagcggcgaataggacttgtcggcgaggttcttgcccagcagcgccacgcgccagccctggttgtagtcggccagggcgatgctggcgttccagatgccgtaggccccctgcctggtgtcggcgttctggctgatgtcgtactgcacttcgctctgccagctgtaatcggtgcccagttcgatatccaggccgttatccagcgggatgctgtaatcggcccgcacatagcttttccaatcagggctgaatggcagcggcttgccgttgacgttgcaagaagccgccgcgcccgccgggcaggcgaattcgtcgatccgtgcgcgggtataggccagcgcgccggagatcttcagttgctgggtggcctgcaaggcgtaatccagctcgacaccttcggtgctaacgctgccggcattgatcaggcgggtcaccacctgcccggcgacggtgtcgaagaagttcgcctgatagttgtcgtagtcgctgtggaagatcgccaggttggcggtcaggcgcttgttccaggccgtggccttgatcccggcctcccaggtgttggaggtttccggtttcagcgcctcggtgtcccgcggctgcatgttgaagaacacgttgtaggccggccccttgtagccgcgtgaataggtcaggtaggtggtgaccgcatcgcttaggtcgtactgcaggcccaggcgcccggaccagccgtcctcatccaccgagcccgagctgctggtgccgggctgaatgccactgacggtggtggccgaggtggatacgcggcggtgctcgtattccaggtcgtcgtgggtccagcgcaggccggcgatcccgcgcaggtccgaggtgaagttcagggtggtttcgccgaacaccgagtagctgtcgctggtggtgctgtagtcggcgatgccacggttgatcgcggtggtagtggtcagggtgcgccggtaggtttcttcatccttaccgtgcatgtagaacaacccgccgacgtactcgagaaattgccccttgggcgaggccaggcgcagctcctgagagtactggttgtagtccaggtcgcccttgtcggcggtaccggggaaagcggcggtaacggcgcccaggcggtcgccgtcctgatactgggtgttgttccagccgcgccaggcggtgatcgaggtcagggtgtaatcgccaagactccagtccagctggccggacaaacctttgttgatgtcttcgacgtgggtacgggtatcggtgttgatatcgcggttgtccctgctggcccggaccgggcgcagggcattggcgaaggccggagccagggccttggcgacaacgccattgggcgcgtcgtcatgggactgcatgtagtcggccgccagggtgaaggtgaggtcgtcgctgggggtgaacgccagcttgccgcgcacgcccttgcggttgtagccgttgacctcatgcccgttgcgccggttgtcgacgttgccatcgtagctgccgaacagggtggtgatcgaacccttgagcgtgtcgggaatcaggctaccgccgatgccgaaccgggtgcggctttcgttgccgctgtagtagctctggtcgatgtagccatgggtctcggcggtcggcgccctggtcacgatattcagcacgccggccgaagcgttcttgccgaacaaggtgccttgcggaccgcgcaaaacttcgatgcgttccaggtccagcaggtcgagggtagcctggcccgggcggccgtagaccacgccatcgatcactgtggccacggtcggctccacgccgggcgaggtggaaatggtgcccacgccgcggatgaacagcgaggtgtccttgttcgaagcgccggtgcggaagttcagcgacggcacctgttgcacgatgctggcgacaccgttgcggttatcacgctccagttgctcgccatcgaccaccgacaccgccaccggcactttttgtagcgactcttcgcggcgggtggcggtgactgtcaccgacttcagcgtcggctcctggccctgcgccgtgctgtcgctgtcagcggcgaaagcgcccggcagcggcagcgcggcgagccccgccagccaccagcccaaatacgcccgtgaagcgctggcggcgcggatcgaccgcaccagtttctgctgatccccatgaatgttctgcatactgcacctgcgcggaatttgcccttaaccgctgccgatctgcgccggcagcgccgaaaaatctgtcgtggacattcgctcgagcgagtagcagacaaggcgctttgttagcgctaacatcgccagtatcggtaagccgcacatagatcgtcaaatactgaaaaattacttttatatgcattttttttgtttaaaggatcgcgcttttgaccgctgaaaaatccccaggccgcaagcgccgcggtgccgggcgggtgaccctgaacaccgtcgcccgcctggccggtgtgtcggcgatcaccgtgtcgcgttatttcaaccagccggacagcgtctcgccggaacgtcgcgagcgcatcgcccgggcagtggccgaactgggttatgtgccgaacctggtggccggcggcctggcctcgacacggggcaagattgtcgccatggtgatcccgaacatctccgggccgattttcgccaacaccatccagggcttcagcgacaccctcagccgccacggttaccagctgttgctggcgtcgagctacttcgatgcgcaacaggaagaaaacgccgtgcgggcctttctcggctggtcgccggccgccctggtgctgaccagtcatttccatagcccgggcactgaaaagatgatcgccgaggcggatatcccggtgatcgagacctgggactaccagccacagcgggaaccgctgcagatcggcttctcccattaccaggtcggggtgacggcgacgcgttatctgtatgacaagggttatcggcgcatcgccttcgtgcagaacagcgcccccggcgacctcagcgccctggagcgccgcgacggttacgccgccgccgtgagcgaactgggcctggcaccctgggtgttcgccccggatgccgatcgagcgccgttcgaggccggcaaacaggccatggaagccctgatgaaaacccgcccacgcccggatgcgatcatcttcgccaacgacaacctggccgccggcggctccctggccgggcaacgggcagggctgaaaatccccgaggaatgcgcggtgctgggcttcggcgattacccctttgccgagatgctgttgcccagcctgagcaccatcaagccaccggcactggagatcggcgtcctggcggcgacccgggtcctggaaagcctgggcgtgttgccggtggaagacgaggtccagcgcctgaacctgctgcagtgccggctgatcgagcgcgagagcgcgtagcaacgaccctcacggctcttcgtgcttatcgcgggcacgggcccccggcgggtgcgagtggccgacgctcgatggcggtaattcgcggctacgccgataactcgcgcaatgccgccgcggcaaggaagcccgaacgcgagcggtagcgctggtcgcgcttcaccgtctggtcgatgcgttccagcaattgctccggcagggtggcgttgaagcgcaccgccttgccgaagtaaggcgtgatgtcgaactcgatcatgccccacacgccaccggcgtaatcgggattgtcgatatgcacgtcgacctcatgcacctggggcagcggttgaccatcggcgaccaggccttcgtaatgcagcgacagggcctctttcacattctcgaaggcttctgccgcggtatgaccggcggaaaaacagcccggcacatcggggacgatcactccatatccggagtcggcatccttgtgcagcacgaccgggaatttcatctcgttgacctcttcgttcaagaccggcctcatttcaggcccgcctgtttcaagatgctgtggatcgtgcccctgggcagatccgcatccgggtgagggatagtgacccgccccggcttgtgcagatgcttgtactggtgatgactgcctttgaccgcgatcagataccacccgtcctcctcgatcatcctgatcagttcccgactgcgcattgccgtgtcctttcgatacgtcccgaaaagccaccctacacagccaaaggcgaagaatacacactatacacattcagataatcaatacagaaagcagcgatgaccggcgccaccctggcccttttcagagcgccctggcaaaaacctccgccagccagtcgacgaacacccgcacccgtggcgacatgtggcggttgtgtgggtacagcacggaaaccggcatgggcggcggcggggtgtcggtgaggatttcctgcaccagcccctgggaaatctgctgtgccatgcggtagcgcgggcactggatgatgcccagcccggccacggccgaggcggcatagatttccgcgccgaacaccgacagcgcgccctcgatagcgacttcccgcagttcgccatcgaccatgaattcgaacggaaacagcttggccgtggtgcgtgagacgtagttcaccgcacggtgccgcgacagctcgtcgaggctcgatggctcgccgtatttgcgcaggtaggccgggctggcgcaggtgatctgctgcaagttggccacgcgccggccgatcaacgacgaatcgcccagggtgccggcgcgcaacacgcagtccaccccttcggcgatcaggtcgacaaaacgatcggcctcgctgatggacagctcgatttccggatagcgcgccatgaattcgggcagggccggaatcacgaagtacttggccagggtgccatgcaggtcgacccgcaaacgccccttcggcgccaccgtgcgaaacgccagttcggcctcttccagctccgccagcagctgtacgcagcgctggtaataggcctcgccgtcgagggtcgggcgcacgcggcgggtgctgcgttccagcaggcgggtaccgagccaggcttcgaactgattgagggtatgggtcagggtggcgcgcggcaggttcaggtcctcggcggccagggtgaagctgctgcgctcgtaaattcgcacgaacaccttcatcgctttgacttgatccacgacgggctccggggctcattgattgttggcgattattgaacagtcaagccaactctggcgcatttatcaccctgggtaaacatgtgaatctgcttccacaccacagccaatcactcattacccagaaggaaattcgccatgactacccagacttcgaaagttgccatcgtgaccggcgcctcccgcggcatcggcgcggtgatcgcccggcaactggccagcgaaggcttcgccgtcgccatcaactacgccaacagcgccagcgaagcctcggccctggtggtggagctgcgccaggccggccaccgggccatagcagtcaaggccgatgtggccaatgccgatgacgtgcgccgcctgctcgacgaaaccgaaacccaactgggcaaggtcgacgtgctgatcaacaacgccggcatcctcaaggtcctgccgctggcgcaacacacggacgaactgttcgaccagaacttcaacatccacgctcgcggcactttcaacaccctgcgtgaagccgcgactcgcctgaacgccggcgggcgcatcgtcaatttctccagcagcaccgtcggcatgaacctgccgggttacgcggtgtacatcgccagcaaagcggcggtggaatccctgacccaggtgttcgccaaggaaatgcgcggtcgcaatatcaccgtcaatgcagtggcaccaggcccggtggccaccgacctgttcctgcacggcaagagcgaagagcagatccagggtttcgccaagatggccccgctggagcgcctggctcaacccgaagatatttcccgcgtcgtgtccttcctggttagccctgattcggcctgggtcaacgggcagatcctgcgcgccaacggcgggctcgtctgagccacctcacccacggtcgaaggagccacgctcatgaatcactccaccgcgacacccgcccgtagcgggcagacgaaaccgatgttcatcctgttcactgcggtggccgccgccaccgccgcattggcggcgggctccagcctgctgctgagcctgccggtctgggccatgttcgttggctgggtggcgttcttcagccgcggcctgaccttgcgcgacggcctggtcaacctgggctgcgtgctgatgggcctcgccgtcggcatgggcgcggcgctgagcattggcgcactgagcccaagcctaggcccctgggccctgccgctggtggtgttcgtggtggcgatgctcgtggtgtcgctgcgcagcctgcgggtgatgaataacatcgtcgcctacttcctcggcctgatcgcctggttcgccgcgcacctggaaccctccctggaaagcttcgccgaactcggcggtgctggagccctgggcaccttcgccggctggctgtcccacgccgtacaacaacgcctgccccggcgtgcctgaaaccaccctcacctgaagagatcaatgccatgcaatccgtcatcctgattaccggcgcctccagtggttttggcgccctgaccgcccgcgccctcgccgacgccggccacatcgtctacgccagcatgcgtgaaaccctgggccgcaatgcgcctcaggtggccgaggtgcggcgctacgccgacgagcaccgggtcgatttgcgcagcgtcgaactggacgtcgcctccagcgcctcggtcgaggccggtgtcgcccggatagtcgccgactgcggccggctggacgtgatcatccacaacgccgggcacatggccttcggccccgccgaagccttcaccgccgaacagttcgcccagctctacgacatcaacgtactgagcacccagcgggtcaaccgcgcggccctgccgcaactgcgcaagcagggccggggactggtgctgtgggtatcctccagcagcgcccgtggcggcaccccgccctacctggcgccgtacttcgcggccaaggcggcgatggactccctggcggtgtcctatgccggggagctggcgcgctggggcgtggagacctcgatcatcgtgccgggcgccttcactcagggcaccaaccacttcgcgcactccggagccccggccgaccaagcccgcgccgccgagtacaaccagggcccctatgccggcgtgccggagcaggcactcaacggcctggccgctctggagccggctgacgccgatgtcgccgaggtcgcgaaggccatcgtcgagatcgtcggcctgcccttcggcacccggccgttgcgccggcacatcgacccgtcccaggacggtgccgaaatcgtcaatgccatggccgaccgggtgcgcgccgagatgttccgccgcatcggcctggaagacctgctcaagcccgccgttcgctaaaacaacgacatggatggcccgggcattccccgggccatcagtgctttccaccggcttattcgcggagacactcatgcgtccgaccactgactcgccagccccacgcaacaccctgctgatcccggccctcacccctctgtaccgcattggcgagcccctgtcctatgccctgctgcgggtctgttatggcgtgatcatgatcagccacggcctgccgaaattgctgggccaggcccacggctcgatggccgatcctatggcggcctcgatcaacctgatccagaacgtcctgcatttgccggcgccagcgctgatcgcgctgttcgtggcgctcctggaaggcgtcggcgggttgctcctggccctcggcctggggacgcgcctgctcgccgccatgatgggcatgcagatgctgaccatcgccggcctgctcggccccacctggccatggatcgaccggggcatggaatacccggtcctgttggcgtttttgtcgttctacattctgtttcgcggagcaggacgctactccctggaccacactctaggtcgggagctttgaaccgccatcgaccctgggcccgcccctgaattccgcccgcgaggacttcgtcatgcataccgcgatcatcacttgcttcggcctgattctcctggcgctgatgctgtttatcggcgaaaagctcggcctcggccgccagaccctggcctacagtttcgtcgtgctctggctggcgctgacggtgatcaacggcgcggtggggatggtccacgccggccagcccctgagcacggagctggcggtcggcagtgtggtgttcggcgtgccggtggcggcgctggtgctgtacacggtgctgaaccagggctgaaacgaccgcgggcaagccccgctcccgatttccaccagaagcaaggcttgcccgcgataacgctgttgcggctgcccgcgatcaacgcaccaggtgcaggaactgcatatggcgttcgtactggtcgaggatgtcgttgatgatctgctccttggtgtagcccatcaggtcgtagtcctggctaccctcggccaggtgcacctcggcccggtagtaacgccggttgcgcatctccttgggccccatgccgccacgggcgaaggacggggtgaagtagccacgcatctgcacctggtagacgaacggatgctggtcgccatggccgatttccaggctgacgttgtcgttggccgggtccggctgggtgatcacgttcaggcctttctcgacgaacaccgcggtcacttcttcgatggccgggcgcaccgtctgatcgaggaagcgatacacctcgtcgcgcgacgggaaatgcaccgcctggctcaggcgctggcgccagccgcccttgccgcgccgcgaagacgacgacaccggcgccagcgaatgcaactgggcgatctgcttctgcgactcgaggtagaaggccttgtgcagcccccacatcatcagcagcaggatcatcgagaacggcagcgaggtcagcaccaccgccgacttcagcgagtcgatgctgccggcgaacagcagcgcgctggtgaccagcgcggtcatcgcgccccagaacacccgcagccatttcggcccgtcttcatcggcattgccgccacgggccgacagggtcgagagcaccacggtgccggagtcggccgaggtgacgaagaacacgaagctgataaacaccgtcacggcgatgacggtcttgctccaggggtaggtttccagcagcaggtagagggtcatcgaggggttctcgatggccgacatgcccagcgcgctcatgccgtggttgagcacctggtcgatggcactgttaccgaagatcgacatccaggccagggtgaagcccaggggaatcagcagcacgccgaacacgaattcacggatggtccggccacgggaaatccgcgcgatgaacaggcccacgaacggcgaccatgcgatccaccaggcccagtagaagaccgtccagccgcccagccagtcgctgggttcgtcataggcgtagaggtcgaaactcttggtcggcaaggcgccgaggtaatcgccgaggttctggatcagggtgttgagcaggtgctgggtggggccggcgaacaacacgaacagcagcagcgcacaggccagcagcatgttgatgtcggacatcacccgcacgcccttgtcgacaccggacaccgcgacaatgatcgccgcgcccatcatcagggtgatcaggcccacctggacccactgggtgtgggcgatgccgaacagataatccaggccggagttgaggtgcagcacgccaaagcccatgtcggcgccgaggccgaacaccgtggcgatgatgccgaagccatccaccgcgtagccgatggggccgttgatgcgcttgccgatcagcgggtacagcgccgaacgcagggccagcggcaggttatgccggtaggcgaaatacgccagggccatgccgacgaaggcgaacacgccccagccatgcaggccccagtgcaggaagagaatctgcatggcctggcgcgccgcatccgcggtcccggcctcgccctggggcggttgcagcatgtgggtcaggggttccgacacacagaagaaaaacagcgtgatgctgatcccggcggcgaacagcatgccggcccaggacaggtaactgaattccggttcgtcgtggtcggcaccgagcttgatcttgccgtagccggacaaggcggtgaccaccacgaagatcaggtacagggtcatggccagcatgtagtaccagccgaccgtattggccgcccagttttgcgcggccagcaaccaggcgccggcttgttccggcagggcaatgaccaccaggccgaaggccaggataaagctcgcggcgaagtagaacaccggcggattcatgcggatcaggccgctggcgggaatggacgatgcactcatgaaacgtgcacctcgagggggtaaaacgcggctgaaaagatcggactcagcaaaggtaagcctcctgttgtgagcgagctgccggtttaacttgaacaagcgttcaagttaaacacggataggcgcgtaaggactaatcgccgggctcggcggtcgcctgatttcgcaggttttaagaaaggtctgatgtgtcgcggagggaatcgttcagcgttaaatagcgcgatctctgtagccgctgccgaaggctgcgccaaggcccgcagggccttcaaaagacccaagtgcggcgctcctctcggggcgatcgcagcctgtggcagcggctacatgatgcaagcaccccggcttatttttgcgacccatcgtcatgctgcaggttggcctgggtcaggttgcagccggccggcacgctgcgggtcagccagacgttgccgccgatggtcgagcccttgccgatggtgatgcgcccgaggatggtcgcgccggcgtagatcaccacgtcgtcctcgacgatcgggtggcgcgggtggcccttctgcaactggccgtcctcgtccgccgggaagcgcttggcgcccagggtcaccgcctggtagatgcgtacacgctcgccgatgatcgcggtctcgccgatcaccacaccggtgccgtggtcgatgaagaagctgcggccgatctgcgcccccgggtgaatgtcgatgccggtggccgagtgggcgatttccgcgctgatccgcgccagcagcggcaggccggcgcgatacagatggtgggccaggcgatggtggatcaccgccaggatgcccgggtagcacagcagcacttcgtcgacgctgcgcgccgcggggtcgccgtggtaggcggccagcacatcggtatcgagcaacacccgcaggcccggcagggccagggcgaaatcctggatgatacggatggccctggcgttgacatcttcgtccgcctcgccgctctggcgcgcggcataacgcagttccaggcgggtctgggcgagcagcgcattgagggccgcgtccagggtgtggccgacgtagaagtcctcgctttcctcgcgcaggtccaccgggcccaggcgcatcgggaacaaggccccacacagcgcctcgagaatctcggccatggccgcgcgcgacggcagttcccgaccgccctgctcaccactgacccgcccgttgcgggtacgccactggtcgcgggcatcacgcagttgaccgactatggtctgcaattgccaatggctggaacgctcgctcacgataagactcctcactcaggcggccggacggtctggccgcgtaaacgacgtcactttacggtatgcgtcccaggccaaattaagaactaattgtgctggcctaagtaccttttggcataagcgattgacggttgccccggtaaatatcgctgcctatagtccctgacacctctgacaacctgtgcggcctcatgatcaaacgacagctcgaccgttttaaccgtctcgacctgctgggcggcgccaccgccctggaaaaactcgaacgcctgtccacctggctgggccgcgatgtctacgtcaagcgcgacgacaccacgccgctggccatgggcggcaacaagctgcgcaaactcgaatacctggccgccgatgcgctggcccagggcgcggacaccctgatcaccgcgggcgccatccagtccaaccacgtgcgccagaccgcggccctggccgctaagctcggcctgggttgcgtcgccctgctggaaaaccccatcggtaccgatgacggcaattacctgggcaacggcaaccgcctgctgctcgacctgttcgacgccaaggtcgagctggtggagaacctggacaacgccgacgagcagttgcaggccctggccgagcgcctgcgcagcagcggcaagcagccgtacctggtgccgattggcggctccaacgccctcggcgcgctgggttacgtgcgcgccggcctggagctggcggagcagatcaacaacagcgggctcgacttcgccgccgtggtgctggcctcgggcagcgccggcacccacagcggcctggccctggccttgagcgaagtgttgccgcagttgccggtgatcggcgtcaccgtgtcgcgcaccgacgaagcgcaacggccgaaggtccagggcctggccgagcgcaccgccgaattgctcggggtggcgctgccggagagcttcaaagtggagttgtgggacgaatatttcgccccgcgttatggcgaaccgaatgccggcaccctggccgcggtgaagctgctggcgagccaggaaggcctgctgctggacccggtctacaccggcaaggccatggccggcctgctcgacggcatcggccgccagcgcttcgacgacggcccgatcatcttcctgcacaccggcggcgcgccggcgctgttcgcttatgccggctcgtttgcctgaacactgacctgtagccgctgccgcaggctgcgatcggcggcgcagccgtcgtaaaacctgcgcatgcggcgcatcagaaaagacacgttcgccggatttgcgcctgccacgtcggaatgccgcccaatcgatcgcagcctgcggcagcggctacagggatgtatatttataaaaagaataacaatgtgaatttatattatttttacatctataagcagccacttatagtcgcgccgcaggcgaatttgccgcgagacgcatacgctgcatttagtgcaggataaggcgctcgttcccgctcaccgattgacctgcatctcccaaccgcatctgcataagaaaacacaggggcttgtcatgattttttccgcactacgtcgaaatatcctcgttggctcgctgggtctggccctcggtgccgggttgctggggcaagcggttgccggtgagcaactgcagaagatcaaggacgccggcaccatcaacgtcggcctggaaggcacttatccaccgttcagctacgtcgacgaaagcggcaagctggccggcttcgaagtcgagttctccgaagccctggcgcagaagctgggcgtgaaggtcaaactgcagccgaccaagtgggacggcatcctcgccgccctggagtccaagcgtctggacgcggtgatcaaccaggtgaccatctccgatgagcgcaagaagaaatacgacttctccaccccctacaccgtttccggcatccaagccctgacccagaagaagaacgaaggcaagttcaagaccgccgccgacctggccgggcacaaggtcggtgtcggcctgggcaccaactacgaacaatggctcaaggacaacgtgccgcaagccatcatcaagacctacgacgatgatccgaccaagtaccaggacctgcgcgtaggccgtatcgacgcgatcctggtggaccgcctggccgccttcgagctgatcaagaaaaccaacgacaccctggctatttccggcgagcccttctcccgccaggaagccggcgtggccctgcgcaaaggcgaacccgagctgctggccgcggtgaacaaggcaatcgaggaactgcgcgccgacggcacgctgaaaaagctctcggaaaaatacttcaacgctgacgtcactcaataatggaagcaggttttcagttcgaactgtctttcccgcagttgagccagcaaatcgccgaaaccacgcagctgttgctgaactccgcgcccttcctgctcaagggcgcgtatttcacggtcatcctcagcctcggcggcatgttcttcggattggcgctggggttcgccctggcgctgatgcgcctgtcgcgcttcaagctgctgagctggatcgcccgcgtctatgtgtcgttctttcgcggcacgccgttgctggtgcaactgttcgtgatctattacggcctgccgcagctgggcatcgagcttgacccactgccggcggcgctgatcggcttctcgttgaacatggcggcctatgcctgcgagatcctgcgcgcggccatcggctccatcgagcgcgggcagtgggaagcggcggccagcattggcatgacccgggcccagaccctgcgccgggcgatcctgccgcaagccatgcgcacggccctgccgcccctgggcaacagctttatctcgctggtcaaggacacggccctggccgccaccatccaggtcccggaactgttccgccaggcacagctgatcaccgcccggaccttcgaagtcttcaccatgtatcttgccgccgcgctgatctactgggttctggccagcgtgctggcgcacctgcagaaccgactggaagagcgggtcaatcggcacgaccaggagtcctgaacccatgattgtggttgaaaaactgacgaagcagttcaagggtcagaccgtcctcaatggcatcgacctgacggtggcggaaggcgaggtggtcgccatcatcggccccagcggctcgggcaagaccacctttttgcgctgcctgaatttcctcgaagaacctaccagcggccggatcaaggtcggcaacatcgaaatcgatggcagccggccgctgacccagcagcagggcctggtgcggcaactgcgccagcaggtgggtttcgtgttccagaacttcaacctgttcccccatcgcaccgcgttggaaaacgtcatcgaaggcccgctggtggtgaagaagacgccccgcgagcaggcgctggccctgggccgcgggctgttggccaaggtcggcctggcgggcaaggaagacgcctatccgcggcgcctctccggcggccagcaacagcgcgtggcgattgcccgggcgctggcgatggagccggaagtgatcctgttcgacgaaccgacctcggccctcgacccggagctggtgggcgaagtgctggcgaccatccgcggcctggccgaggagaaacgcactatggtcatcgtcacccacgaaatgggcttcgcccgcgacgtggccaaccgggtgatcttcttcgacaagggggtgatcgtcgaacagggcgaagccaaggcgctgttcgccaaccccagggaagaacgcacccggcaattcctcagcaagttcctcacctcgggccatccccaggcctgagcggcgccctcgctgccgagcccgggatgggctgtgcagcgaacgcaaacccgccatcacattccgccagacacatcgcatacgccggtttacgacggctgcgccgccgagcgcaggctgcgccagcggctacagaaaccgcgttcccctgcaaccgcgccccctgtagccgctgccgagcaacgcgaggctgcgatcggtctgggcggcattccgacacagcggccgccagacccgccactgcattgcgcccggaaaaccgtatgccccggttttacgacggctaccccgccgcgcgcaggctgcgccagcggctacaggcctcagatctatctcccattacccttcgccttttcctacctgccgtatacgtaaaccccttctatacatattcctaaaagttagtttatttaatttttatacgcgcatagggtatatgcaccggaccaccggacattcttgaacccgatttcgccgcccacggcgcggcacttccaaagatgtgaggtaggtatggtccggaacacaatcaccccagtgcagatcgccagggcattgcgtgcagccaaggagtggcactgatgtccaatctgaccgatgcaaatgtccagagcgatctggatgtcgcccccctgttgttgcccgcacgggttctgctgaacgacgcagaagcccttcaagccgcccatgaactggccaccgtcgcccgccagcaggcggcccggcgcgaccagcagcgcaagctgccgtgggcggaaatcgaacatttcacccgcagtggcctgggcagtattgccatcccccgtgagtacggcggcccgcaggtgtctttcgtgaccctggccgaagtcttcgcgatcatttccgcggccgacccggccctgggacagatcccgcagaaccagttcggcattctcaacctgatcctcggcagcgccaccgaacggcagaaaaagcagctgttccagagcgtgctggaaggctggcgcatcggaaatgccggcccggaacgcgggaccaaaaacaccctggaactcaaggcacgaatcaccgccgacggcgacggttacctgctcaatggccagaagttctattccaccggcgccctgttcgcccactgggtggcggtcaaggcgctgaacgacgacggcaagcaagtattggccttcgttcggcgcggcacgccggggctgcgcatcgtcgacgactggtcgggcttcggccagcgcaccaccgccagcggcaccattttgctcaacaacgtgcgggtcgatgccgacctggtggtggacaactggcgcatcaacgaatcgccgaatatccagggcgcggtgtcgcagctgatccaggcggccatcgacgccggcatcgcccgcgccgccatcgacgacgccatcagcttcgtgcgtgaacgctcgcggccgtgggtcgacgccaacgtcgaacgggccagcgacgacctgtatgtaatcgccgacatcggcaagctgaaaatcgaactgcacgccgccgaggccctgctgcgcaaggccggccaggtgctggaccaggtcagcgccgcaccgatcagcgccgagtccgcggcccgcgcatcgatcgctgtagccgaagccaaggtgctgaccaccgagatctccctgctggccagcgagaaactcttcgagctggccggcagccgcgccaccctcgccgagttcaacctcgaccggcactggcgcaacgcccgggtccacaccctgcacgatccggtgcgctggaaataccacgccgtcggcacctatcacctgaacggcaccctgccggctcgccattcctggatttaagcgaccagatctctggagaagtacatgactctttctcaacacgtcgcggtcataaccagcgatgagcaagccctgatcgtcgccagcgacctggccgaggatttcaagcgcgacagcgccctgcgcgaccgcgaacgccgcctgccccaccccgaactcgaagccttttcccgctccggcctgtggggcatcagcgtgcccagggaatacggcggcgccggtgtgtccaacgtcaccctggccaaggtcatcgccctgatcgcccaggccgacggctccctggggcagatcccgcagaaccatttctacgccctcgaagtgctgcgggtgaacggcagcgcggcgcagaaaaaacgcctgtacgccgaggtcctggccggccagcgcttcggcaatgccctggccgagctgggcaccaagaccgcccacgaccgcaccactcgcctgacccgggacgtacaggacggacgcgacggctatcgcatcaacggtcgcaagttctattccaccggcgccctctatgcccagcgcatccccacgtcggtggtggatgaacagggcgtgcagcaactggccttcgttccggcgggcagccagggcctgaacgtgatcgacgactggagcggcttcggccagcgcaccaccggcagcggctcggtggtattcgaggacgtgttcgtcgccgccgaggacgtgattccctttcagagcgccttcgagcgcccgaccaccgtcggcccgctggcgcagattctccacgccgccatcgacaccggtatcgcccgcgccgcctatgaggacgccctgcatttcgtgcgcaccaagacccggccgtggatcgactccggcaacgacaaggccactgaagacccgctgaccctcaagagcttcggccacctgagcattcgcctgcacgccaccgaggcgctgctggagcgctccggggagttcctcgacgcggcccaggccgagcccaacgccgagaccgtggccgccgcctccatcgcggtcgccgaggcccgcgccatcagcagcgaaacctccctggccgccggcagcaccctgttcgagttggccggcagccaggcgaccctggccgaacacggcctcgaccgtcactggcgcaacgcccgggtgcacaccctgcacgacccggtgcgctggaagtaccacgcggtgggcaactactacctcaaccagacgaacccgccactgcgggggactatctgatgagcgctctggagaaaggcaaaaaaaagatcctgctcaatgccttcaacatgaattgcatcgggcacatcaaccacggcctgtggacccatccacgggacacctcgacccagtacaagaccctcgaatactggaccgagctggcgcagctgctggagcgcggactgttcgacgggctgttcatcgccgacatcgtcggggtctacgacgtctaccagaactcggtggacgtgacgcttaaggagtcgatccagctgccggtcaacgacccgctgctgctggtttcggccatggccgcggtgacccgcaacctcggcttcggcctcaccgccaacctcacctacgagccgccgtacctgttcgcccggcgcatgtcgacgctggaccacctgagccgtggccgggtcggctggaacatcgtcaccggctacctcgacagcgccgccaaggccatgggcctgagcgaacagaccgaacacgaccggcgctacgaccaggccgacgaatacctgcaagtgctctacaagctctgggaaggcagctgggaaaacgacgcggtgatcaacgaccgcgaacagcggatctacgcccggccggagaaggtgcacaaggtcgagcacaagggcgagttctatcaggtcgagggctatcacctgtgcgaaccttcgccgcagcgcacgccggtgctgttccaggccggcagttccgatcgcggcctgctgttcgccgggcgccacgccgaatgcgtgttcatcagcgggcagaacaaagcctcgacccgcgcccaggtggacaaggtccgcgccagcgccgtggcggccgggcgcaatcccgaggacatcaaggtgttcatggggctcaacgtgatagtcgccgcgaccgaggagttggcctggaagaaacacgccgaataccgcagctacgccagcgccgaagccggggtggcgcatttctcggcgtccaccgccatcgacttttcccagtacgagatcgacgaaccgatccagtacgtgaagagcaacgccatccagtcggccaccaagaacctgcagaacaacgactggacccggcgcaagctgctcgaccagcacgccctgggcgggcgctacatcaccgtggtcggctcgccgcagcaggtggccgacgacctcgaatcctggatcgccgagactggcctggacggcttcaacctgacccgcatcgtcaccccggaaagttatgccgacttcatcgacctggtgatccccgagctgcaacgccgcggctcgtacaagaccgcctacgacaacggcaccctgcgcgaaaagctgttccggcaggacgcgcagttacccgagcaacacagcggcgccacctatcgccactaaccctgtagccgctgccgaaggctgcgataaggcccgaagggcctcccaacgatctcaagagcacgtcctcttcgaggccgatcgcagcctgcggcagcggctacaggtcacctgaacatcccatgcactgactggaaacctgaccatgacaaccaagctcttaagccacccagtcaaagcactggccctcgccctcggactgttcgccagcgcggtattcgccgccgacgcgccgctgaaagtcggcaccaccgccgccttcgccatccccctggaggccgccgtcgaagaggccggcaaacagggcctgaaagtcgagctggtggagttcagcgactggatcgcgccgaacgtcagcctggccgccggcgatatcgacgtgaactacttccagcacatcccgttcctggaaaacgccaaggccgccgccggcttcgacctggtgccgttcgccccggggatcatcaacaacgtcggcctgtactcgaagcaatacaaaagcttcgacgaactgcccgaaggcgccacggtggccatcgccaacgacccgatcaacagcggccgcggcttgcagctgctggccaaggccggcctgatcagcctcaagccgggggtcggctacaaggccaccgaggacgacattgtcgccaacccgaaaaagctgaagatcctccaggtcgaggccgtgcaactggtacgcgcctatgacgacgccgacctggtgcagggctacccggcctatatccgcctggccaagaccttcgatgccggttcggcgctgctgttcgacggcctcgaccacaaggaatacgtgatccagttcgtgatccagcccaagagcaagaccgacccgcggctgatcaagttcgtcgatatctaccagcattcgccggcggtgcgcgccgccctggacaaagcccacggcaagctctaccaagccggctgggaaggttgagatgagcgtctcctcccttgcgcacaagtcgccgaaccagccgcccgaacagcggcaggacgcgcagcagaccgagctgcatccagaactgaaccgagcccacgtgcgcttcatcggcctgaccaagacctaccagggccagcaaggcccggtgcaggccctgcacgggatcgatctggcgatccagcgcggcgaagtgttcggcatcatcggccgcagcggcgccggcaagtcgtcgctgatccgcaccatcaaccgcctggaacagccttcgggcggccgggtgctgatcgatcaggtggacatcggcgactttgacgaagaccgtctggtggagctgcgccggcgcatcggcatgatcttccagcacttcaacctgatgtcggccaagaccgtgtggcagaacgtcgagctgccgctgaaggtggccggcgtgcccaaggaacagcgcgagcgcaaggtccgcgaactgctggagctggtgggcctgaaagacaagcacaaggcctacccggcgcagctctcgggcgggcagaaacagcgggtgggcatcgcccgggcgctggtccacgacccggcgatcctgctgtgcgacgaggccacctcggcgctggacccggagaccacccagtcgatcctcggcctgctcaaacagatcaaccagcgcctgggcctgaccatcatcctgatcacccacgagatggcggtgatccgcgatatctgcgaccgggtggtggtgctcgagcatgggcatatcgtcgagcaggggccggtctgggaagtgttcggcaacccgcagcacgaggtcagcaaaaccctgctggcgcccttgcagcacggcttgccggaagagctgcaaaaccgcctgcaggcccagccgaagtctgccgacgcggcggtggtattgcgcgtgcagttcaccggcaggagcagcgacgagccggacctggccgcactgttcagcaccctgggcgggcgcgtgcggctgctgcacggcggcgtggagcggatccaggggcatgccctggggcaattgctgctggcggtcagcggctcgtccctgggcgccgaggagcaacgtttgcgcgcgcagcactttttgcacaagcaatggacacaacaggtagaggtgctgggttatgtggtttgatcgcttgctccagggcgttatcgataccttcctgatggtcggtgtgtcgtcgctgatcgcgctgctggcgggcattccgctggcggtgatcctggtcaccagcggcaagggcgggatctatgaagcacccaggctgaacagcgtgctgggggccttcgtcaacctgttccgctcgatcccgttcctgatcctgatggtggcgctgatccccttcacccggctgatcgtcggcactacctacggcgtctgggccgccgtggtgccactgaccatcgccgccacgccgttcttcgcgcggatcgccgaggtcagcctgcgcgaggtcgaccacggcctgatcgaagccgcccaggccatgggctgccggcgctggcacattgtctggcatgtgttgttgccggaggcgctgccgggcatcgtcggcggcttcaccatcaccctggtgaccatgatcaactcctcggccatggccggggccatcggcgccggtggcctgggggacattgcctatcgctacggttaccagcgtttcgacagccagatcatgctcacggtgatcgtgctgctggtgatcctcgtcgcggcgatccagctcggcggcgaccgcctggcgcgggtgctcaacaagcgttgagatcggcggtgtccattcggatgtcatcgcgagcaagctcgctcctacaggttgatcgcgtcgccctttgtaggagcgagcttgctcgcgattggctttcaaggcccacaccaaacccgggtcaatgcccttggagtatattcggcacatcactccagccaacgcagcccgccatgaaactcgctcccgacgacctcaaccagatcacctccaccaccctgggtcactacaaccaggtggccgaagatttccgcgaaggcacccgcgaccacgatgtcagccagaacatcgacgcgctgcttcgacatatccagggcacggcgcccttcaccctgctggacttcggctgcggccccgggcgcgacctgcaaaccttcacgcgcctgggtcatatcgcggtcggcctcgacggctccgaacgctttgcccagatggcccggggcgacagcggctgcgaggtctggcagcaggactttctcaagctcgacctgcccgccgagcgcttcgacggcatcttcgccaacgccgtgctgtttcatatcccctcgcaggagttgccgcgggtgctgcgccaactgcacgccacgctgaaacccggcggcgtgctgttcagttccaacccgcgcggcgacaaccgcgaaggctggaacggcgcgcgttatggcgcctaccacgacctggcggcctggcagcaattgctcaccgcggcggggtttgtcgagctggagcattactaccggcccgccggcctgccgcgggagcagcagccgtggctggcgagtgtgtggcgcaaggtttgagcggtttgccagataggccgtagcgcctggttcgcgggcaaacctcgctcctacgtaggagcgaggcttgcccgcgatggcgtcctctcgaacgagcacaatctcaagccgtggttttcttcggctccttgatcttgtaccaggccacgtacagcgccggcaggaacagcagcgtcagcagggtggcgacgatgatgccgccgatcatggcgtaggccatcggcccccagaacacttcccgggcgatggggatcatgcccaggctggccgccgcggcggtcagcaggatcggccggcgccggtgctcggtggcttgcaccaccgcatcccagggtgaatacccggcgtgctcgaactcatcgatctgggtcaccaggatcaccgagttgcggatgatgatgccgatcagcgcgagaatcccgaggatcgccacaaagcccatgggcgtgcccgtcggcaccagcgccaggaccacgccgatcagccccaggggcgcgacgctggccaccaggaacagcttctgcacgctgtgcagctggatcatcaggaaagtcgccatgaggaacagcatcaacggcaccaccttggcgatcggcccctgggccttgccgctctcctccaccgtgccgccggtggccaccgaataaccgaccggcaggctggcggcgaacttgtcgatgtcgggcttgagcaacctgaccagatcggtcggctggatctcatcacgcaccgaggccttgatggtgatggtcggcttgcggtcacggcgccagaccagcggctgctccagttcgtaacgcacggtggcgaaggccagcagcggaatcgaggtgccgttggggttgacgatctgcaggttctgcagggtttccggggaaccgcgctcgctgtcgtcggcccggccgaccacgttgatcaggtagatgtcgtcatgcacctgggtcacggtggagccactgacgatgctgttcatcaactgcgccacgtcctccgaagacagccccaactggcgggccttgtcctgggcgatgtcgatgcgcagcactttgcccggctcgttccagtcgtagatgatctcgccgatgtgcgtgttcttgtccagttcggtggccagctcgatggcgtgcttgcgcacctggtcgatgtccttgccgctgacccggtactggatcggccgccccaccggcgggcccatttccagggcctggacgtagctgccgatgccgacgaagtcgtcgcgcaggcgttttttcaggcgttcggtcaacgccgtgcgcgactccaggcccttgctgacgatcaccagctgcgcgtagtaggggttctgcagttgctggtccagcggcaggtagaaacggatcgcgccttcgccgatgtaagtgctccagcgctcgatgtccgggtcgtccttgagggtcgcttccagacgatccaccgccatgcgggtctcggcgatcgaggcgttctgcggcaggttgaggtcgacgagaatctccggtcggtccgaggacgggaagaactggttctgcacgaagcgcataccgaccaccgacagcacgaacgccaggacggtgataccgatggcccaccagcggttgcgcatggcccacagcaggccgccgttgaaggcgcggccgatgcggcccggctcctcggagtggggcttcacattggtgctgaggatatgcacgccgatcaccggggcgaacagcacggcgactatccacgacaccagcatggccacggcgatcaccgcgaacagggtgaaggtgtactcgccggcggaactggcgttgaggccgatgggcacgaagccggcgaccgtcaccagggtcccggtgagcatcgggaacgctgtggaggtgtaggcgaaggtcgccgcctgctccttgctctcgcccatctccaggcgcgtgaccatcatctccacggtgatcatcgcgtcgtccaccagaaggcccagggcgatgatcaacgcaccgagggaaatccgctgcatggtgatgccgctgtattccatgaagacgaagaccatcgccagcaccagcgggatcgagcacgccaccaccagcccggcgcgcacgcccaggctgacgaaactcaccaccagcacgatcaccaccgcctcgaacagcgcgctggtaaagccgccgacggctttttccaccacctcggcctggtccgacaccgtgtgtacgcctacgcccaccggcagctcggcggtgagctggtccatcttggcgtgcagggccttgccgaagtcctggatgttgccgcccttcttcatggcgatcgccaggccgatggccggctggccgttgaagcggaactgcggcgtcgaaggatcgacgtagccgcggctgatctcggcgatatccgccaggcgatagaagcgctcgttgagccgcaggttgaccgtggccaggtctttctcggaagcgaactgccccgaggtgcgcacggaaatccgctccggcccggcctcgatcacccccgccggggtcaccgcgttctgcgattgcaggctctgcaggacctggcgctggtcgatgcccagcgccgccagcttgcgtgtggagaagttcaggtagatgacttcgtcctgctcgccgaccatctccaccttgcccaggttcggcacctcgcggacctcggcgcgcacctgctccacgtagtcgcgcagctggcgcatgctcaggccgtcggcggtaaaggcatagaccgagccgaacacgtcaccgaattcgtcgttgaaccccggcccttgcaggccctgggggaagtcgccgcgaatgtcgttgatcttcttgcgcacctggtaccagatctcgggaatgtccttgccgctggtggtgtcgcgcaggtagacgaacaccgtcgactcgccggggcgggtgtagcttttcacgtagtcgagggagtccagctcttcgagttttttctcgatgcggtcggtgacctgcttgagggtttcctcctgggtcgcgcccggccagcgggtctggatgaccatggtcttgatggtgaaggacgggtcttcctcgcgccccaggttcatgtaggagaacacgcccatcagcagggcgacgaacatcaggtaccagacgaacgactgatgcctgatggcccactcggataaattgaagctcccttttgtggccggcgtcatcgtgggctgccctcgtcgattttgactttctgccccggtttgaggctgttcacaccggcgctcaccacccgctcgccgattttgatcccgctgccgatcaatgccgaatcatggtcccggctgagcaccgtgacctcgcgcggcgccacggtccgtgcctgcgggtcgacgatccagacccgggtctggccgtccacttcctgcagggccgacagcggcacctcggtgcgcgggacgatggcggagctgagggtcacgctgatggccgtgccgaggcggaacgcttcgggggtttcggtgagggtcaggcgcgagcgccgggtgcgggtggcgctctgcgcctggggttcgatttcacgcacgatggcggtggtgttgatgctcgggtccagctgcgaggcgaccttgaacaccacgtcggccggcaactggtccaccagcgtcgccggcaggtcgatcaccgcttccttgatgtccggacgggccagggtcaccacctgctggccggcgctgaccacctggccggcctcggcgttccaggcggtgaccacgccgccgtgatcggtgcgcagctcgctgtaggcgagttggtcgcgggcctggctgaccgcggccctggcctggtccaacgaagcacgggtggttttcaggtcggtctgggcgatatccagctgcgcctgggcgccgacgccacggtcgaacaattgctgctggcgccgggcgttggcctgggcattgatccattgcgcctcgatccgggccaggtcgccctgggcggaacgcaactggttctgctggtcggtggggtcgagggtggcgagcaaggcgcccttgcccacctcggcgccgacgtcgacattgcgattggcgatgcgccccggcacccggaaaccgaggttggtttcatagcgggcctggatgctcccggcgaaccgcccgaggctttcctcggactcggcgcgcacctcgaacgacagcaccggacgcaccggctcgggcgccggttcttccttggagcaggcgcccagcgtcaggccggcgcacaacagcagggacaggcgcttcatggctgggctccttgggtgccggtctcggcaacgatctcgacgagcatccccgggtgcaacaactggccaccggcgatcaccactttttcgccgcccttgaggccgtcgctgatgatcaccttgccggtctggtagcgccccaccgtgacggtgtgcagggtggccttgccgtcctcgcccaccagccatacggccggctcgttgaggttcttggtcagcgccgcccagggtagttcgacactggcctggccggccgcctgggcactggcgctgaccaccgagcccaggtccatgcccgccggcaggccgtcgagggccaccttgacctgcaccgtgccgctctgcgccgacaccaccggggtgacttcacgcaccttgccggtggtcttgatgttcgggttgtccagcaggctgacggtgatcgcgccttgcttcggcggggccaccaacagcgattcgtagacgttgaacacggcgtcgcgctcgccgtcgcgggccaggctgtagatcggcaccgtggcctgcaccacctggccgacttcggcctggcgcgcagtgatcacccccggcgcatcggcgatcagcgcggtgtagctcagttgctcgcgggcgttggccaactgcgcctgggccgcgctcagggcgctctggctgctgcgcagcgccgcctgggcggcatcgtattcgctctggctggtatagcccttgggcaggagtttctgctggcggacgaaggccgcgctggtctgcttgacccgtgcctgttcggcgaacaccgaggcggcggcggaatcgacattggtctgcaggtctttcgggtcgagccgggccaggacctgtctggccgtgacccggtcgccgacgtcgaccaggcgctggatgatcttgccgccgacgcggaacgacaactcggtctgcacccgcgcctgcacatcgccggtcagggtcacctgcgcggcgaaatcgcgggtctgcacttgctgcacgcgcacccgcggccgctccttttcgctcggtttttccgcgccacaaccgctcagtagagcagccagcatcaaacccactatccacttcgattcgagaccagccatgcaggctccttggcgcgacgccatcgtacaggtgacgatacgactgtgagcttagaacagggttccactgctgcgcgcgggctgctgcggaacaaatgcgtaatggttgatcggctgagcaacgaggacgtcgtgacgcgcggagtttcaggttctgcgaacctgatcgcgagcaagctcgctcctacaagagcagtccgcaggggcgatggcttaggggaaaatcaggcacactgcgcctccatgcacaaggagccccggcatgctcaagaccctggcagtggccaattaccgctcgatcaacaaactggtgattccgctgcagcggctgaacctgatcaccggccccaacggcagcggcaagtccaacctgtacaaggccctgcgcctgctggcggaaaccgcccagggcggggtagtcaacgcgctggccagcgaaggcggcctggagtcgaccttctgggccgggccggaacagatcagccggcgcatgagccgtggcgaggtggcgatccagggcgggccacgcaaaaccgtcaagcgcctgcaactgggctttgccggcgaggacttcggttactcgatcggcctggggctgccggactccagcggccatttcatgctgcccgggcacagcacaccgattccgtcgcgcttcaccctcgacccgcggatcaagcgcgagagcatctggagcgggccggcgtatcgcccggccagcgtgctggtggatcgccaggggccgatggtgcgggcacgccaggggcggcagtgggaagtcctggcgcagcacacctccagcggcgacagcctgttcgaccaggtcggcaacctgcgttcatcgcccgaggtcctgcatttgcgcgagcagattcgcggctggcgtttttacgatcacttccgtaccgacagccaggcccccgcgcgccggccacagctgggcacccgcacgccggtgctgcaccacgacggccgcgacctggcggcggcgttgcagaccatcatcgaagtgggcgatcagcaggcgctgcacgaaaccatcagcgacgcctttccgggttcgcggttggagatcgatgccgtgccgggcggctgttcggcgtgcagttctatcaggacggtctgctgcggccgctgtcggcggcggagctgtcggacggcaccctgcgctacctgctgctggtcgccgccctgctgacgccacggccaccgacgctgatggtgctcaacgaaccggaaaccagcctgcacccggacctgctgccggccttggcgcgcctgatcattcgcgcctcgcagcagtgccaggtgtgggtggtgtcccatgccagccggttgatcgcggcgttgcagcaacacccggagtgcaactgcatcgtgctggagaaaaatttcggccagaccgaaatcgtcggccaggggatgctcgatgaaccggcgtggtattggccggattgagcggcctcaaaaacatcgcgggcaagaaccaggcgtcccccctgctcctacggggtgcaatgcttgccggcatggtcgcatgcaatccctgtagccgctgccgcaggctgcgataggtccgaaggacctcggcgaccttgaaaccgctgcgaccgttctccgaacgcggcccgggtcgatcgcagcctgcggcagcggctacaggggctcaggcacagactgtcacccctgccacttgccgccttcgacaatcacgctttcaggcttggtgtcgtcgctcagttccttgcgcacgtactggtcgtagagcttgagcaggtacttgtcctcgcccagcttggccagttcggcgttgacccagtcacgcagttcgatattgcccttcttcaccgccggcgcgatcggtgcctgctcccccagggtctgcggcagtacgcggtaacccgggttctgcttggaccagctgaacaggatcaggttgtcctgggcataggcatcgccgcggccgttggccagggcttgcagggactcggagttcttctcgaacttcagcagtttccagtccgggtggttcttggtcagccagatatcggcggtggtgccggtggtgacgatggtggtacgggtcgccaggtcatccaggctcttcacttcgctgccatcaggcaccagggcctgcaccgcgaccttgaggttggggttggtgaactccaccgcttccttgcgctccggggtgacggtcatgttggccaggatcaggtcgaccttgtcgctctgcaggaacggaatgcggctggccggctccaccgcgacgaactccaccttgttctcgtcgcccagcaggtccttggcgaattgccgcccgatatcggtatcgaagcccacgtagcggccggtctcgtcgacgaaaccgaacggcggcttgtcggtgaacacgccgacgatcagcttgtcgcgggccttgatcttgtccaggtagccggccgccggggcagcgctggcgctggccgcgggcttgggcgcttcggcggatttatcgcagccggccagcagggcgaggccgaacagcgggagtagcagtagcgaagacttggcagttttcataagagctccagttcctttgcagggatcttttttggcagtgtttcaacgaaggagaatttctccaggaactgctgcgctcgtgcggtccgcgggttcgtaaagaagatctcgggagggtgctgttcgaggatgcgcccggcatccatgaacacgatgcggtcggccaccgcgcgggcgaaggccatttcgtgggtgacgatcaacagggtcatgccgtcccgggccaggccctggatcacttgcagcacctccttgaccatctccgggtccagcgccgcggtgacctcgtcgaacagcatcacctgcgggttcatgcacagcgaacggacgatggcgatgcgttgctgctggccgccggagagctggcgcgggaaggcatcgcgcttgtccgaaaggcccacccgctccagcagcgcctcggcctgggcgcgggcttcgcggcggtcgcgtttctgcaccttgagcgggccgagcaggatgttgtcgagcacgctcatgtgcgggaacagatggtagctctggaacaccatgccgatgtcctggcgcacctggcgccagtcggtggccggggccagcagctcttggccggcgaatctcaggtggccgccgtgggctttttccaggccgttgaggcagcgcagcaaggtggacttgccgcagccgctggggccgagaatcaccaccacttcgccctgggcgaccttgaggtcgatgtccttgagcacctgctgctcgccgaaaaacttgttgaaaccctggaactcgatcagtgcgctcatgcttgcgtccagcgccgctccagcacgcgcgaggcggccgacagcgggtagcagataaagaagaaaaacaggaacagggcaccgtagatcagcaccgactcgtaggtgcgctcgatgatctgctggccgaccttgatcacgtccaccacgccgatcagcaccgccagcgagctggtcttgatgatccgcgtgtagacgttgatggtcggcggtgtcatgcgtttcagcgcctggggcagcagcacgtagccatacagctgcgggtcggacaggccgatcgacagccccgcctcgcgctggccacggggcagcgaatgcagggcgccgcgcaccacctcgccgacttcgctggcaccccacagcgacagcaccagcaccgcgcaggtgaaactgggaatgctgatgccgaagaagatcgggaaaccgaagaacagcaggtacagccagaccagcaccgggatcgcccggaacagctccaggtagatgcgcaacacggcgttcagccatttgcgctcgagggtccgcagcacgccatagagcacgccgccgacggtgctgaaggcgatgctcagcagggagatcgacaaggtctgcgcggcgcccttgcccagttgcggcaaggacacccagagcagttcaagacccgaactggccatgctgcaacctcctttccagacggctgagcaacagcgacagcggcaagaacagcagcacgcagatcagcgtgagcacggcgagcatttcgtaggtcttgtagtagagggcgatgtagctcttggtggtgtagagaatctccggcaccgccaccgccgagaccacggtggtttccttgagcaggaaaatgaaattggcgaacagcgacggcaggctgaggatcccggcctgcggcaggatcacgtagcgcagcagctgccagtgcgacaggccgatggagcgccccgactccagctgggccgtcggcaccgcttcgacgccggcgcgcagcacctcggtgaggtaggcgccgccgagaaaggtcatggtgatgatcgccgcggcgaacccggaaatcttcagccccagcgccggcagggcgaagtagacgaagaacagctggatcagcagcggggtgttgcgcgccaactccacgtacagcccgatcaggcgctgcaggtagggggtgcggaacaccaggatggtggcgttgatcagggccaccagcagggaggtggcgatggcgatcaggccgacctgcaaggtcacgcccacggccttgaggaaggccggcagcgtactgaggataaaagcgtagtcgagggtcatggcaatcctggacgccgctggggtacagcggcggtggtgcagtccattgggcggtgggtaaccacccggcaggcatcgactttaaagctataaaaacaataatttaaataccgttaaagcatattgatatcactcaaaaaactaacctgcggggtttgccatgcgcgcctgagccggctacttttctgacgccataagggatctttccgattccaaggaacggacaagcggcccccgacttcaacgggccagacatgtacatggacgataagaacaatgaccgacctcaataccccgcaacctctcgatccgcaggacatcgtcaaatggctgaaggccctgtgccgggccatgaagccttcctgagcaaaatctcttcatcgttgattgcccgtagttgcgcccttgccgatacaccgcggcgcctggatcgcgagcaagcttcgctcctacagaagcaaagtgaagccgttcttgcgggcaataaaaaacgccgacgctgtagaagccatcggcgtttaaaccttgaaggggtttgtacaacgttaagcgtagttcatcagaacgccggcagtaccgcgccgctgtatttcttctcgatgaattctttcacttgcgggctggtcagggccttggccagtttctggatggcggcgctgtccttgttgtccgggcgggccaccaggaagttcacgtaaggcgaatcggcaccctcgatcaccagcgcgtccttggccgggttcaggccggcttccagggcgtagttggtgttgatcatgtccaggtcgacctggtccagcacgcgcggcagcagggccgactccagttccttgaacttgaagttgtgcgggttcttggcgatgtctttcggggtcgccagggcgtttttcgggtccttgagctcgatcaggccggccttctgcagcaggatcagggcccggccgctgttgctgccttcgttcggaatggcgatggtcgcgccgtctttcagctcggccagggttttgactttcttcgagtagccgccgaacggttcgacgtgcacgccaaccacggtcaccaggttagtgcccttgccttcgttgaagctcttcaggtacggcagggtctggaagtagttggcatccagacgcttctgatcgacctgcacgttcggctgcacgtaatcggtgaagactttgatttccaggtccacgccttccttggccagggtcggcttgatcagctcgaggatctcggcatgcggcaccggcgtggccgccaccacgagtttctcgccagcctgggccagaccggcagtcagggcagccgccagtgcggtgaacaacagaacctttttcatgcagtgtccttatgagtcgtcagtgacgacggcttttgtaatgaaggtgccagcgaagtgctatctctggcgtggagcggacaataccgggattttttatgccttaacaatatcttttattcacgttgatattccattttgttcatacacagtcgggccgctctagcccgcatccggggcgctgtgcatgcccctgtagccgctgccgcaggctgcgatcgagcacgcagcgctcaccaggttttcaggctgccttcaaagggattgtggagtcgtatgggcggccgctgcgcagccgatcgcagcctgcggcagcggctacagaaagcagcccgctgcacgaatcaggaatgggaggggacttcagatcacaccatgttgcttgagcaggtgtttcagcgcctgcaactcggcggcggaaccgtccgcgatcaggcccttcaactgttgatccaccagctccagccgcgacagctgcggcggcaggttcaggtgctccggcaggatctcctcgccactgctgaccagcagggcaaagtgaatgacgttctccagctcgcgggtgttgcccggccagctgtgttgctccagcacctgctgggcggcttcgctgatcagcggcaccggcaggtccaggcgctggctgtagatgccgaggaagtattcggccaacgacaggatgtcgccgacccgctcgcgcagcgccggcagttccagatggccctcgccgaggtagtgatacagccgctcatggaacttgcccgccgccaccgcctgggccaggtcgatgctggtggccgccaccaggcgcacgtccaccgggctcggctgatgggcgccgacccgggtcacctcatgattttccagggccgagagcagcttgatctggatcggcaacggcaagtcgccgatctcgtccaggtacagggtgccgccgttggccgagccgaaccagccggcgcggctgctggccgagccgctgaaggtgccggcggcgtagccgaacagttcggcgtcggcgtaggtagggctgatggccccgcagttgaccgagacgaacaggccgctgcggtcgctggcgcggtggatgtgccgggccagcagctccttgccgctaccggtttcaccgcggatcaacaccgagatcgcccgcggcgccagctgttccagctcctggcgcaactgccgcgaacggggatcgacgaacaccagcgccttggcgcggatgctcagcgggcttttttcagcatcgggaaaggtcagcagcggctggccgaaagactcatgcagactcatggcagactcccgcccaaatccgctggcaggcgggggcgtttaacaaaaagaaaaaatcaggcgcggcgcagggaatgctgttccatgcggttttgcaggcgatagagatacgcgaaaccctgctcccagcgctggtgcccggacttgacgttgatatgcccggcaccggacaggatccccgcctcggcgccccagttgcgggccagctccagggcacgcggcgcactgatggcgctgtcgttgtcggagctgactatctggctcgggaacggcaacaggtcgctggggatcggcgcgaaattgcgcagtgccggcgcacaggccggacgctcgacatccgccggcgccaccagcaacgcaccacgcacctggcgcaaggcgctggccggcgcatgggcggcccagtgtgcgacggtgatgcaacccaggctgtgggcgatcaggatcaccggggtgctgtcggcggcaatcgcctcggccagcgccgcgacccagtcttcgcgccggggcgtcagccagtcggcctgctccacccgcgcactgttcggcaggctgttctgccagtggctttgccaatgatcttctggcgatccttgccagcccggcacaatcaggtagcgaattgattcgttgcgcatggggagctctcctgcgtgtctgttcccgatcgagtatagggatgagagttatattcgttaaggaataagaagctatttattaagatccataaagaatatcaaacaccgcctgtaccgatcctgtacgaacgctggtgttcaggccggcaaaccgcagtgcctgcatcgcgagcaagctcgctcctacaggttcgtggcgcccgccggcttttgtaggagcgagcttgctcgcgatggcgtcggtccaggccagcgccccgagccaaatcgcaggcaaaaaaaaggccgcaccctgccaaggagacggcctgaaaagtcgtggcttacaacactgggtcagcgggcggtgatcaccgaaagcttggtgataccggcacgctcgatggaggccatggcacgggccacttcgccgtagttgacgccgtcgtccgcctgcagctgcacgcgcacttccgggtccttggccttggccgcctgaagattggtttccaaaaggtccggctggatctcgtccttgttgataaaaagtttgccggcgccgtcgatgctcaccaccagcgggtccttctgctccaccggggccacggcctcggtcttgggcaggttgatcggaatcgcgttggtcaacagtggcgcggtgacgatgaacaccaccagcagtaccagcatcacgtccaccagcggcgtgacgttgatctcgctcagtacctcatcgctgtcctgggtcgagaaggccatgtcaggacgcctccttcactttctgcgcgctgccctgggccgcggccttgtgcgcggtcgggtggatcagcacgcggaacgaactcttctgcgccaggctgtagaagtcatgggcgaagtcgtcgaggtcggcggcggtcagcttcaggcgccgcaggaaatagttgtaaaccagcaccgccggcaccgcgacggcgatccccacgccggtggcgaccagcgccgcgccgatcggcccggccacggtttccaggctcgccgagcccgccgcgctgatgcctttcagggcttccatgatcccccacacggtgccgaacagaccgatgaagggcgaagtgctgccgatactggcgaccaccgccaggccggtttccagggaacgccgctcacggacgatctgctggcgcagggcgcgctccaggcggtcctgatgattgatggcctggctcaggtccgtcgcgtgcgctgtgtcgccgacctggatcgccgcgtagccggcctgggccacacgagcggcggcgccgggctgggtttcgctgagctcggccgccgagtcgaggctggaggcggcccagaactgtttgtgaaacttgcgatcctgggccttgaggcgggcgaactgcgcgcccttgagcagggccaggccccaggtggccacggaaaagaccaccagcagccagatcaccgcgctttctatggattcgagtggagatgccaataacgtcatgttcttttccctctgtataaccttgtaggagcgagcttgctcgcgatagcgaccgaccaggcacagcgcctggcgcaggctcaatgaatcttgaaatcgatgggtacgctgacccagccgtcctgggcgacatcaccctgcttggccggcacgaagctccagcgcttgacggccgataacgccgcgtcgtcgagctgctggcgaccgctgcttttctgaatctggatctcgccgggcttgccgctggccagtacatgcacccgcagcagcaccgtgccttcccagccgcgacgctgggccagcgacggatattccggcgccgggttcttcaagtacgcggcattcgccgaagccggggtcacgggcgccggggccggtggcgcgggcggagccggagcggcgacaggcgcggccggttgtggcggcgcgggctgttgctggaccggtttcggcgccggcttgggcaccggttttggtttaggtttgggaatcggcttgggcggtggcggcttgaccgccagttcgtcctccactggcggtggcggctccaccaccggctgtaccggctgcggtggcggcggttcgaccaccggcggcgcgggccgggaaaactcgatggtcatcggcggaatttccggcggcacgatcggcaataccggcgtcggctgctggttgatccagtagatcaccgcaccgtgcaacagcagggcgatcaccccgagtgcaatcgcctcgcgccgccgcagcccggccttgggagccttctgcaaacgcaattggcccaacggcaagcgatgcggccggccgagatcgaccagatcgccgctcggtgcctgacgccacagcacctcatgtgcactggcggcggtctggacattgcccattgattaactccctacagtcttttgcgaataacccgacccgcacctgcgaactcccccggagcagcgtcgagggctgaatgattggcgccagacacttatctccgaaagtaatctttaaagttatggatagatcaaaaacgcatatttaaacccgtcatctcgcgccaggccgcgcggatcaagggctgcagggaatgagtcaaaaagccatgctttgcgagcattgaaaatattcgccaaaggcatcgcatcgccgcggcaaaaccgcagcgagcgacagccgtgacgaaataaaaagagaccgaccgaacgtcgatcaaaggaatcagggcgcacccgataaagcggatctcaagcgcccctgaacagggaagttcagacgctcagtacctggctctcacacagcgccagcagctggctttccagggccttgccggctcggctcaagccgctgctgccgtataacgccaggcgcacgccctggatgtccggcaagccgctggcggcatcgagcacgcggtgcccggcgctcaccactcgcaccggcagcaggctgatgcccaggcccgccgccaccgccgagcagacgctggccaggctggcgctggaataaccgatgcgccaacgccagccgccaacctcgaggtggtgcaacatttcatggcgatacaaaccgcccaccgggaacgccaccaacggcaacggatcgcggccaaaggccggggtggcgcggctgtcgacccagcacagaggttccggccaggacgccaggcagtcgtcgctggcgcccatctgcttgaccagcaacaggtcgaattcgccgcgtcgatagagccgggtcaattccgggcccaacccgctggtgacctccaggcgtacgccgggatggtcctggccgaagcgcgacaacaacggcatcagccgctcggcggcgaagtcttccggcaccccgaggcgcaacacgccttcgctctgttgatgcagcaagacatcgctggcctcttcgttgagggccaggatccgtcgcgcgtagcccagcagacgctcgccctcggcggtggccaccacccggcgctggtcgcggtcgagcaactggcagtccaggctctcctccagccgccgcacctgctggctgacggtggactgggtgaggtgcaggcgctcggcggcgcgggtgaagttggcgcagtcgacaacggcgacaaagctgcgcagcagcacaggatcgaacatggcagcaccattctgaataccactgattggcatggttatatttaatttcagaatacatcagggcctgagcatactcggcgctcgatcagcgcggcacagcccaacactggcgcgacgccgcgcgcccgatacggagcccccatgaaagacgatcaggagtacctgcaacgcgccgtcgaactggcccggcaaaacgtcgcggccggcggccggccgttcggcgcggtgctggtgcgcgacggccaggtgctggccgagacggtcaaccagatccacctgacccaggaccccaccgcccacgccgagctgttggccatcctggtcgccagccagcggctcgggccgcgcctggacggctgcgtgatctatgccagcggccagccctgccccatgtgtttgagcgccatgtacctgtgcggtgtggcgcgcgcggtattcgccgcggacaacgccagcgccgcccccttcggcctgtccacggcggcgatctacgaacaactggcccagcctctggcggcccagcgcttgccggtgcagcacctgccgcaggcggcgatgcacgagatctaccgcgactggcaggcccgccatgccgctcgctgagtcgcgtctgcgccgcctcggcggctgggtcctgctgatcgccctggggctcaacctgcggccgatcatcagctccatcagcccgctgctgatggaaattcgtggcgccaccggcatgagcttccagagcagcgcctggctcaccagcctgccggtggtctgcatgggcctggtggccttgctcggggtgcgcctggaagcccgcctgggagaacggcgcggcgtcgccctcggtctgttgatgatcctctgcgcctgcctggcgcggttgctctgcgaccaggccggcgccctgctcgccacggccctgctcggcggtgccggcgtggccttgatccaggcactggtgccggcgctgatcaagcgccagttccagcaacgggtggccttggctatgggcatttattcggcctcgctgatgggcggtggcggcctcgcggcgctgctcagcccgcaggtcgccacgcatttcgcccattggcaggccgggctcggcgtgtggctgttgccggcgctggcggcgctgctgctgtggtggctgctgcctttcgccgggccggggcagcgcctcgacgcccccgccatcagcctgtggcgcaaccgtcgggcctggttgctggcgctgtacttcggcctggtcaattgcggctacatgagcatggtcgcctggctgccggcctattacctgcaattgggctggagcgcgacccagagcggttcgctgctggcgttcatgaccctcttccaggtcaccgccgcactgttaatgcccgccctggcgcagcgccagagcgaccgccggccattgctcgccatcagcctgagctcccaggccctgggcttcagcggcctggtgttgtggccgctgcaggccccgcagctgtgggtggcgctgatcggcttcggcctcggcgcctgcttcgccctgagcctgatcctcaccctcgaccaccgtcgcgatccccgggaagccggacagctggcggccttcgtgcaaggggtggggttcctgatcaacgccgtgtcgccgtggatgaccggctggctgcggcagctcaccggcagctttatcagcgcctggtgggtactggtcctgagtgtgctggccatgctggtgctgacccgggtattcagcccctccagctaccgggagccacagatggcgaccacggcagcacaaccggcctccgcgatgccttaaagatcaaggcccatggccactatgcgcaacttcttgcgcacccctctgtggataactctgtgaacagttatccaagggctcgataaaccgggacctgcagccaagtgcgcaacttcttgcacagcactgtgcaagaagttgcgcactttcaagcgctttcgagctggaaataccgtcagcgatgccagaaaacgccggaagcccttgttccgtaaggcgctttcaactcctggcatgctccttgatatcaacttggcacccaaccgggcgatccgtcccaccgggcacctttattttttagcaaggagagcatccatggctacaccagcgtatatgtccatcaccggcaccaaacaaggcctgatcaccgccggtgccttcaccgctgactccgttggcaacacctatcaggaaggccacgaagaccaggtcatggttcagggcttccagcacgaagtgatcatcccgcgtgacccgcagtccggccagccaaccggccagcgcgtgcacaaacccgtagtcatcaccaaggttttcgacaaggcttcgccactgctgctggctgccctgacctccggtgagcgtctgaccaagatcgaaatccagtggtaccgcacctccgctgccggcacccaggagcactactacaccaccaccctggaagacgcgatcatcgtcgacatcaaagactacatgcacaactgccaggacccggcgaactcgcacttcacccacctggaagacgtgcacttcacctaccgcaaaatcacctggacccacgaagtctccggtacttccggttccgacgactggcgttccccggtcgcgggctaagtccggccgaccgttacaccaacatcggccagctctgctggtcgatgttgtttacgccataagggatttcttgcgttcgtcggcgcccggccccggggtcgacccacgcggcagtactgcacgaggaacaagggatgttcgcgccggccaatcagacccacttcagcctgaccgtcgaaggtttggagaacgacctccaggtattgtccttcaccggacgggaagccatcagccagcccttcgccttcgaggtcgagctggtcagcgcccaggccgccctggacctggaaagcctgctgcacaaaccggccttcctgcagttggcgcagaatggcaccggcatccacgggcagatctaccgcgtcgcccagggcgattccggcaagcgcctgacccgctattcggtgaccctccgcccgcacctggcttacctcgcgcaccgcatcaaccaacgcatcttccagaacctcacggtgccgaaaatcatcggccaggtcctcgaagaacacggcatccaaagcaacgcctaccagttccagctgggttcgatctatcccgagcgcaactactgcgtgcagtacgacgaatcggacctgcatttcatccagcgcctgtgcgaggaagaaggtatccactaccacttccagcacagcgccgacagccacaagatcgtcttcggtgatgaccagacggtgttcccgaaactggcgccagtggcctaccagcaagactccggcatggtcgccaacgacccggtgatcaagcggttcgacctgcgcctggaagcccgcaccagccgcaccacgcgccgcgactacgacttcgagaaaccgcgcctgaccctggagagcgacgccaagagcgagttcaaaccggacctcgaggattacgactaccccgggcgtttcgtcgaccgcgagcgcggcaagcacctggccaagcgtgccctggaacgccaccgcagcgactaccgcctggccgagggcaagagcgatcagccgctgctggtcagcgggcatttcctggccctgagcgaacacccgaaagcgcaatggaacgacctctggctgctcaccgagatcgtccacgaaggcaagcagccgcaggtgctggaagagtcggtgaccagcgacaccacggcgctgaaggacgacttccaccagggttatcgcaaccgattccaggccacaccctgggacgtgcccaaccggccgccgctgctgcaccccaagccgcgcatcctcggcagccagagcgcggtggtcaccgggcccaagggcgaagagatccactgcgaccaatacgggcgggtcaaagtacagttccactgggaccgcgaaggccagtcggacgacaagaccagctgttggctgcgggtgtcctcggcctgggccggcgcccagtacggcggcatcgccatcccgcgcatcggcatggaagtgctggtgaccttcctcgagggtgaccccgaccagccgctgatcagcggctgcctgtaccacaaggaaaacgtggtcccctacgacctgccggcgaacaagacccgcagcaccttcaagaccctcagctcccccggtggtggcggctacaacgagctgcgcatcgaggacaagaagggccaggaacagatcttcctgcacgcccagcgcgactgggacgaaaacgtcgagcacgaccagaagatccgcgtcggcaacgaacgccacgacacagtcgaggccaacagctacagcgagttcaaggcagaggaacaccacaccgtgcacgccgaccgcaaggtcgaagcgcgcgccagcgaccacctcaccgtgggcgtgaaccagcacatcaagatcggcaccgggcagttcatcgaagccggccaggagatccacctcaatgccggggtgaaggtcgtcatggaagccggcagcgagctgaccctcaagggcggcggcagctttatcaagctcgacgccggcggcgtgaccatcagcggcccgcaggtcaaggtcaactccggcggcgccccgggcagcggctccggcgccgcgccactgatgcccggcgtgctgaagcaggccgacgccgacaaggccggcgccctgctgaccccggcgcaaatcaacaccctcaaacgcaacgcgcctttctgcgaagagtgcgaaaagtgcaaggacggtgcctgtgccatctgatcgcctgacaccccaggcctggctcgcccgccagcccctgcaacccgacgagcgcctgtacctggtgatcagcaacgccagcgacgccaacccgctcaaggacttctaccagacccagggcgccagcggcctgaccgccctctggagcggcacgccctacgccgactggcagccggtgatgccctacctcgccgaactcaaaccgacctcccccttcctcgactggatcgccaccaccgacgccgacgactggggctggctcgccgtctccggctgcgaaccggcagtggtgttcgaacacctgcgcagcctgacccaggtgaagatgccgggcggtgccgaggtgttttttaggttttgggatgggcggcatatttatccgattttggaggggttgggcgaagacgccccccaagtcctgccgatattcgaccgctacctgatcaatggccgggcgttgaacgtcggccaaggtgtagtcaagccaccgaagccatttccctggtgggaagtgccggaagcgctggtcaagaagctcgccgaggatgaccccagcaccgtgatcgacaacatgatgcagtggctgctggaagaccacgccgagctgtatttctcgttccctgaatccaacttgcggcagaaggtggcacgtttcgtaaaacgcaccccgctcacggaagaaaactacaccgggctattgaaagcccacttggaaaatgaggtggttgcatgagcattttgttgggggaattcgccgttaacctgacggctaaacagccggatgctcaagtcatcatccgcgacttcaagaaatgcctggccgactaccgtgctcacgccgaagcctggtacggcggcgtgctggacgccgagcagcagttccaggtcggcgacgaagtggccacccaggacaaggacagcaaaagccgcgccgatctttacgcgaattgcccggccaacggcaagctcaagctggtgcacagctttgaatccgcgcgtttcgtaccgatcggcaatacgccggtacgcctggtgccagtggtcgatggcatggtctacggcaagaacgaagccggtgccgccatcaacgtcaccatcggccccagcggcatcaaggaagtcacggggctcaagcccaaccagcaatacaagatcactttctttcccaacccgacccgtgcgcaaatcgactcgctgttcaactcttatcagggcgtgattggcgacctgagcggctggctgcaaaccgaatggagtaccgacttcctgccgctgtggaaggcccataacaacgcttccatcggcggccgggcgctacagcagctagagtcggcctggaagggtttcctgaaggccatcatgggcttgtggggcgatatcaagagcctctacaacctggtggcccaccctcgggaaaactaccagaagctgaagaagttcttcaccgaggaagaaatcaagaagatctacaacgcctcgaaaagcgccatccataccgccctgctgattgccagcgacgagccactgatgtggatctacgtggcggcgattgtcgcctgggtgaagatgctgccgccgcaaacctgcatggaagtgctggccgagctgaccaccgaagtgttgctgaacatcctgatcgggattgtgctcaccggaggtattggtctggccgtacgggttggcaccaaggcactcaaggccacgcaaagtggcggcaaagtgctgaaactgatcgaggagttcacctccatgctgatgagagtcagcaggaaaaacgcaaccggtcatgccgaggcatccaaaccgttattgctcaatggcaatgcggcgttgagccccggtcgcaaggccactgtagaaatcgccgcgccgaaaccggcagcgacggctacaccgcccaagagcaaaccgaaagcctctggcggcgcagtggaaaccgatgcgcagatccaggcgcgtggcaagaaaaagcccgccacccgcgccgagcaaaatgaacccgtcagtgacgcccccaagcagtctacaaacccggcggataaaccagcgcggtgcacaaaagacactcgctgcgaaggtgaccccatctcgatggtcaccggtgaggaactgctgaccctcaccgatggtgaactcgatggcctgctgcccctggaatggacgcggctgtatcgcaccagcgcggtggaagtcgacaaccgcctgggtttcggctggagccactcgttgtcccatcggttgcaaatcaacgatgagggcgtgctgtggactgacaacgaaaatcgccaaacccagtttccactgccgaccgaacagcgtccggccattaccaatagcctggccgaggctgcgattttcctgggcgatgctccgggcgaactgatcctgactcaggccgggcaaggcgcgcgcttctatcactttcgtgccgggcgcctgaccaccatcagcgatgcctataacaaccagctacacgtcagctacgacctggtcgaccgcatccagcgcatcgacaatggtgcgggtcgctccctgtttttgcgttacgacgaccgccatatcgccgcagtcgactatcagcagcgacgtcccgactacaacgaacagggtgaacgccaggaaccctggctgacggtccagaccctggtcagctaccagtacaacgaacacaaccagctgatcagcgccaccaatgcggtgggtgaagtcgaacgctatcgctatgacgagcagcatgtcattcaggagcgccaactggccggtggtgcgagcttccgctgggagtgggaacacgaaggcaaggcagcccgttgtatccgccagtggtccaacctatcgcagatcgatgcacgctatgtgtgggacgacgaaggtacggtcaccgttatcaacgccgatggcagcgaacaggtctacgtgcacgacgagaatgcgcggctggtcagccagaccacccctgacggtgcagaaactcaaaaagcctacgatgaaaaaggtcgcctgatcgctgaaaaagaccctctcggggccatcaccgcatacgagtacagtgaggccgggcgcctgatcgccgtgattcctccagaggacgaatccacctattacaattatttcgatggtcatctcatcgaagttcgacgcggcaacgcgcagtggaaatacgaacgcaacgatcaaggcgacatcacccaacagaccgaccccgatggcaacgaaacccactaccgctacgaccgccagggccgcctgctggaaatcacccatcccgacggcagccgccatcaactgggctggaacggcctcggccaactgctggaagaacgcctgcccgacggcggccagcgcaagtaccgctacgacgccctcggtcgacagatcacccgccaggacgaaagcggcgccatcacccattaccagtgggacgccgccaaccgtctggcacagatcaccctgcccggcggcgcgacccgcgccttcagctacaacgcctacggcaaagtcaccgccgagcgcgacgagctgggccgcatcacccgctacgaatacgccgacaacctgcacctggtcagccgccgcatcaatccggacggcagccagctgcgctatcgctacgacaacgcacgcctgctgctcaccgatatcgaaaacgaacgcggcgagcagtaccacctggattactaccccaacggcctgatccagcaggaaaccggcttcgacggccgcagcaccgcctacgcctacgacctcaacggcaacctgctgaagaaaaccgaattcggcgacgacggcagcgagctggtcaccgagtaccagcgcgatgccgctggccgtttgctggtgaaaaccctggccgatggcgaaaaaatccactacagctacgacgccctcgggcgcctggtgaatgtcgacgacggccactggccgctggcctacgaatacgacttgcaagaccgcctgatcaccgaacaccaaggctggggcaccctgcgctacgagtacgacaaactcggccaactcagccattgccgcctgcccgatggcagcaagctcgactaccgccatgcaccgggcgggcaactgagcagcatcgacctcaacggctcgcgcctgaccagccaccagttcaacgccggccgcgaacagcaacgccaacagggcctgctgctcagccagtaccagtacgacgaacaaggccgcctgcaggcccacagcgtcagccagcaacagcacggccagcaccaaaacctctaccgccgcgcctatgcctatgacgccaacggcaacctcgccggcatcgacgacagccgcaagggcaacctgcgttatcactacgacccgctggatcgcctgatcaacgtacgtggcgccaccccggaaagcttcgcccatgaccccgccggtaacctgctcggccaaggcgaccaacccgccgccaacctggccaacgtcaaaggcaaccgcctgctgatgcagggcgaccgccattacgactacgacgccttcggcaacctcagccgcgaacgccgcggcgcgggccagaaactggtcactgaatatcagtacgactgccagcaccggctaattggcgtcagcctgcccggtggcagcaccgccacctacaagtacgacgcctttggccgacgcatcgctaaaaccgtcgatggccgtactaccgagtttctgtggcaaggcgaacaactgatcgccgagagcgctgaaaatcgctaccgcacttacatctacgaacctgactctttccgcccgttggccatgctcgatggcgaaggtccggcacatgccacgccgttttattaccaactcgatcaccttggcaccccacaagaactcaccgcttacagcggcgagatcatgtggtcggccaagtaccgtgcctatggcaatctggctacgttggacgtttccgaaatcgacaacccgctacgtttccaaggccagtacttcgatacggaaaccgggctgcattacaaccgccatcgctactacaatccgagctctggacggttcttgaccccggacccgatcaagctggcgggggggttgaacaactaccagtacgtgcctaaccctacggggtgggtggatccgttggggttgagtggctgcttaggccaagacggaggtaaaacaggaaactcaagcaaccccgcagcaaaggcaacagtggatgagaggagtccaaaagctcctgctcctcaaatgacagcgcagcagcgacaggcaaggattgaggagctttctgaggcaaatgccaaacggcgggttcaggaacttgaagctaagtacaatatgcatactgttgggaaacatggtccagagattcctgatgcaacgatgagacaaagggcaatagatggcaccgatcctattacagggactcagggacgcttgaataaaagctcccagttcaaaacatggaaactacatctaaatgctctcaacgaagctcttaccagaaaagcccgcggtttacctgctcatactggcttcgatagaaacaacaaccctatcgttagagtagaacaacccggagcaggtcgaggttataagccaaataggcgcgaccctcagaatccgatattaaacgaaaacatgaatggcgcggagataaaattcgatagagctgatccagataggccttttactgctttccctatagattaaagccaaaaaatccactggagaatttatcatgttgatggccccgcatactgatttaccttatcaacctaccattgcttcgtttttagcgggcatagatacagaatacagagatgaaaacttcaaaaaagacctattaaaactggacccaaatgactacaacgacagaaaaaaaataattatagactacatattaaaagatcaaaactaccttacataccggcacaagctagttttaatcgaggaattgaaaaaggcaatctcaaacaaagaatatgatttcgattctttatttgaatacgactatgataccgaggaatactcttcgtcgccctgggccgcaaatgaaatcattactcccagaagtttttttgaagacattcttaatattgcacgagatgtgtggagcgaagaccttgtaaaagccgcatctgaagatagatccacatggtaaacaaaacccaccatcaaactaaacacttgtgctcatgatggagcactcaaacatcgcggagtttttcctgcaagataaatcgacttttccagcttgcagggagtttacccaatagataggatcttcaagtcgctgcaaaatcagcgagaagggtgtggaagcccttttgagatccaagcgaaagaacctccattaagcatgctttttacatgctgttagattatggcggttgtacgcggggcactttctagtgcgccgggctcctggagcctcggtcttccacacccgcatacgactgccaccctcatgtggaagtgatgcaggcagtttctgaaactgacccaggaagatcatctatgtctcgctaaatgcccatcacaggaatcgacaacaaccttccttcgctgctatcgacacacaagcccctatcgatgtgctgcatgacaccgccgcataccgcatccgatgcgtcactcaactacttgaaacaatttctctaaccgaaaacttcaacagtgacccactactgctacaagatttgtcgcgagtgatcgtcatcccactccgagatggctgcgatctgatggatgtcatcggtcgtaggttgcgggatcagggtctaagcgcctaaacccgttctttaaaaaatcagcaatgtcctgtcaacgcagcgtgacgacctgcgctgatcttttcttatccggattactaaaatgaataaaaaactgacctcaatatatttcgcagcttgctttttattttcgacatagataatcctgacaatgactccgaaatcagacaagacaccatagcttcaaaaaacataaatgacatccgagaactctcagagcttttcgatacaatgctaaaaccagagtttcttgcatacactccagaagcacgcgaacgctgcataaaaacattggaatcctttttaaacacagatgaaaacttcgacttcctatttgataaaataaccacccactttaatgatgacatcgaagatcaacggcactttatgcgaacacttcatcattgcttaaaccgctataacacaaaagttcaacaccgcgctcaaaacacacactctcttaagaaagcaaattaaaatgaaaatcgcacttgatatagaggaagcatttggcgctatagactacgataacgctggaggacttataagccatatggatatagcgctaacagaaaaattctacgagacaccaaaaatcaaaataacaaacttcatcctcaacacaattgacgagccaataatagagcaattaacaaatcaagcttcttcagtaatccctgaaagaattataagtgacggtttcatcctggtgaaaagcgcgcttattgaatttgaagagctagacagactggaatcggagttctcaatacaaaccggagacggcaagcatacaacgcaaagtagttggggaagaaaactccaaaacaatgacaaaatatatgatctaggcggaaggcttttattcaacccaaacatcagcataaaactatgcctcataacctccaagaagataaaattaacgtactctaccaacgacgcaatacttattgactcctacacagaccttacccacgaaatagaaaaagccaatcaagaaatgaaaaataaaacttcatcaacacctgcaacgctttttgacatagaggtgataaaaaaccatactaaatccgattcagacaaaggttacaacatttatttcgaatcataacccataaaaacaattcttcttgtgcttgccattatttaaaagccaaaattaaagttaagataaccaatgcatcacgatcgaactcctggcacaggaactgacggtcgacagtagcgagatcatgtggtcagccaaagtatcgggcttacaacattctggaagctctggatgtcgaggaaatcgacaagccgccgcgattccagggtcagtacgtcgatagtgaaaccaggctgcattacaaccggcagcactattacaatccaagtttttgacgagtttggttccaggctcgatcacgttggcgggggattgaaaaactaccagtacatgccaaaccctatgggatggatccactagaaggaaattgaaaagttgcaagcgaacgccgactctcaaatttttcattaacccaggaaggtagcatgagtaccgaaacctatagaaagttcgcaaatatcagtttaacccctatcggttcattggaaaatacggccactgttctcggagatattcttggcgttaccttcaagaaagataatgaaggcacatatgacgaataccctgcctttctggcaagcacaccaaccctgaaatatgcacttctaggggttccacaccccgaagatgatttgcgcgaagaaccatctaacgagttcaatttgctagttagccctatagacgatgactcagatcttccagaaattgacatatcagaggaattaatcagtcagctaataaaaagtagcgtcgtacaatgctggagacttaattaaatcccccccgaagttgtaacactcatacaacaaagacggaggtagcaaaaacaagcgccccatctgtcaactacagcaaagctgcaaccaaaaaatcaaccacttaataaaatattacaaaccaagaaatagagaaaagcttcaagcttctgcagagacttttcctacagaacgcgtcgacttcttccaacttgtaccccctcatatacccagatagcatcttccagtcgctgcaaaatcagtgaccggttttgacagatctaatatgatcgaggtaagaagtacaagaccaatccacactataatgacagcatgaatggggctgaggtgaaactcgactcagcggatcgtttacttaccgcattcctgactaaatgagaccttgatgttattagataaagattcaggtactccctactgtccaacgccagcgtatttcttaggtggatttgatatctacgacagggaggaaactctaggaaccgaactcgaaacttacaatctggaagatccaaaatatcgtatcgagctgatagagaaatattgccttaacagacacgaaaacctttcatatagacataaatttgttcttttgaaatctttggaaaatgcattacttgataagaatttcgactttaacaagttacttgaagatgatcccgaagaatattcgtcgtttccatcaggatggaacgaaatgaaaaacccaaaaacttttttcgaagagatcttgaggctggcaagcgaaaaatggaagagtgatttagccaaagcgagcattgaagatccatcaacttggtaagagccctcgaccatcaaaaggcgctcacccccctcaaaaaaccagtaaaagcctactcttcaggaaaatcaatttaaatccatgtacataaataaaaccccaaaaaccgagtccgcttcatacattggagggaaaccagtcatcccccaaggaatgagcatacccaaaagcccaaacggcagtttgatgagcttttacttcacgctgcaatttccagagactcactcactacatggccacacactaagtatttttgccgcgactgaggatttcaacgaagaccatacgattcctgagatgctcaaagtcccgctatcgggggcaaccattccagataactttctaagcgattaccaaaaatactttgcggcctttcttttcaagaatgaagaaaaaacctatgcaagtgactacccgatacggatcgcaatgactcccttagcatttagccacagtaaaggcagcgatgtattcggttgggctggtgataagcccaagtggctcatgggggatgagacaccggcccaatacaagggagcggccttggactttttattgcaaatacatggagagcagtcatttccgactgttgatagcgccccttcacaacaagaaatggatatttctggcaaaagcaagcctagaacaaaaagaaactacactttatttaaccagaacgaaatatacttctttggaagtagaacatcagatgttgataaccgcgtctacatagtcacgcaatgcgactgacataaagctcaaccattagtacaaacaaatgaatacactgacgctcagacaaaaaagcatcatccacaactgcttactcgacctcaaagactcttcttccctgaccatccaaagttttctacctgtagcgctagacaagctcgcaacttcggagggttttggcattgacatgtcgggaatttatctcagtactgatgaggactttgaaaacatccccgaatacctgaaagaaggaatagcattcgagttcatgggcgagcacgtagtgctttcattttctgacggagcctccgtcatcagcaactggtgcgacaataacgccatatcagatcgtgaaagcattttgctaaaatgcaaaatattgaaagcaaaattctcaatggaagactagtcagtaacaaacatcaagctcgcatcgataatcgcgatgcgatcaggcaaaagctggtcgcagagactgacaggaacactaccgtagctgcctctgcaaacggctcatgcttcgcccgtagaccatgctcgacgggagtcccgctcacaagccaagccgtccttcaatacgcccccttgtcgggcctactgctccacctaccccatttgtttattcccgcgctcatccgtctaatccctatcccatccaccgcaacacaacgaagccctcatgactcgatacatgctttacccgctattcctgttttcccttctgctcaccggctgcgccaccaagttcgacgtcgcgctcaatggcacgccggatccggactatcaatttgatcggcaggcgccggtgctggtgacggccacgacggggaatgacgagaattcgctgaatgcccgttattacctgcgcgatatggtcaatgcgttgaaggaccaggggtttcgcgaggtgtttaccgaggcgtcgctacccaagaagcatgcgccgatcaagatgacggtcagcattgatatccatagcaagcaagtcacttaccgctacaccgccaccgactacggccgggtgcagaacagcacttccacggtgtgcaaggatggcaagaaaaagaaggaaaagctggtctgcaccagcacgcccaatacgtcttatggtccggtaggcacctcggaacgcaccggctacaccaccctttcgacctttaccgcgacggcccgggacgaaaccactcggcgtgcggtgtatctgctgcgggtgtcctcttacaacgaggattgccagaacggcaaggtcgaggccttcctggtggagcaaggcctgcagaacctggatttccgcgaccgcgtacagcgcaattacacggtcaccatgcctgaaaattacagctgcaaataagcctgcagagacctcgcgatgcgccgtctgaaccggcgctatcgcgagcgagcctcttcaggtaacccagagccgcgcagcagccggatcaacggctggcattggtcggttgcaaagccgccgccggtgcaatcaccgccgtttccgaacgcggcgtgccttgtggcacccagtcatagctcaccggcaacgcgcggtacacccagttgctgatggcgtcgctgcccggggccttgccgaggaacgggctgacgtattcccagacgttttcgccgcttgccgtgacctggaagaagcggccgttcatgccttcatcaatcagggtattgccgttgggcaggcgtcgggcgctgctgatgaacgagctgtagaaggcccagcccggctgcctggaactggcggcgctgtactgccagacgatctgttgggtcacggggtcgatctccagcactcgcgagccggaaatcagccccaatggcaccgaggggtagccggccgtgccctggttgtcgaacaccagcaggttgcccgcgcccggcaggccggcggggatgatgtgggcgtcgtgctggccgacgaactggtccaccgggcgcggcaaggtcgccggcgctcgcgggttgagagtcggcaggttggggccgaggcgccagaccagcttgccgctctgcttgtcgatgatggcgatgaagttggcgttgcgggaatcgaacagcaggttgtccggggcgaagcgtttgtcgccggcgtcgaaccacttgttcgggccaaccacgctgaggttgttgatgtgcaggtagtccgggtccttggtggtgcgcaccagcttcaactgctccggggtaaagccgaattccttgaggtgttcggaggccagccactgccatttcacctcgccctgggggctgacttcgtagatcacgtcatcgatgacttgcggcaccttgaagcccgccaccgcatgtaccttgttggccagcaccagggtgttgccattgctcaggcggcgctggtcatgatgctgctgggccgcaccgccaggcgcctggtcgccccattgccagaccactttgccgtcccagtccagctcgccgacgctctggttgcccaggccattgccggccgagccgagtttgccggggtccttttcgctcagttgcaacagcacccggccacgcgcgccgcccaccagctgcgggtcgatgatcgccgaaggaaagccggcctggggccaggttttcacctcattgccattcatgtcgatcaggtgggttttcttgtccgcgccactgaagatcacgtattgattgaaggccttggccgggtcgtaacgagtcacgccggtggggtagacgctgggggcggcgaaggccccggcactgaatgacagcagcaggggcaacacgggcttgaggttcaacatggtggaactcctgttcaggtcgaaccgcgccgcggaacccggcgcgggttgcaaatgagggtgttcagaagtcgtagcggccggtcacgccaagggtccgcggcgtgccgagcaaaccttcgtagccgccattcccccccgaccacagcgtggtgtagtaggtcttgtcgaaggcatttttcagccacagcgacacgtcccactgcccttgctcatagttgccacgcaggccggtggaaaggttgaccaccgcgtagctggggatctggccgtagtcggaatcctcgacggtgccgacggccttggagcggaaggcgtagctgccggtgacgtagggttcgaggccgttgtccaggttccatttgtattcgccgttggcgttgccgatccatttcgaggcgccgaccacctggtggccgctgaggtcgcaggaggccggggcgcccgggcgcaggctgacttcaggcgggcacggcgcatccttgtaggacaggtagcgcacgtcgttgtaggagccgttgaggttgagggtcaggccacggatggggatcagcgtgctttcgatttccacgccccgtgagcgcaccgagccggcgttggtcaggtactgcacacggttgttggcgtcgtaggcgttggtctggtagccgttgacctgggtccagaacaggttggcgttgagttgcaggcgcttgtcccacagggtgctcttgaagcccagttcggcattgttggcgcgctcggtgccgatcagcagcgagtcggcgccagcggtgggcgccgagccgaccgcgaggttgaccccgccggacttctcgccgtgggacagggtggcgtagcccagcaggtcgtcggtgaagcggtagctgaggttgagcaggcccgaggggctggtgctgtactggttgagatcgccggagtcgtaggccccggcccgcccgcgccgcgcggtggccgcggcaccggtcaccgcggcgccccccactggcgcgttgcgggtcacccaggcgcttttctcttcataggtgccgcgcaggccggcggtgaaatccaggcgctcggtgaggtgccaggtgccctgggcgaacagcgcgaagctgtcggtgcggatatgcccgttgccgatgctggtgacgttgttcagggcgccgttgggcgtgccgttccagatgtccgccttggggccgtaataggcgaaggacttgttatcgaggtcggagccgaagtagtaggcgccgagcacgtagtcgaagaagccgccggtgggcgaggccaggcggaactcctgggaccactgtttatcctccaccgagactccggcgttatagctggccggcacgttgagcccatcgtcgttgcgcggtgtgaagtcccaccagcggtaagcgctgaccgacgtcagggtgaagtcgctgggcagggtccagttggcctccagggaggtgccgccctggaacaccgtgacgtgctgatcgttgtccaggttgaccttgcggtgcgtgccgtcgaccagggtggcgccagccgcggcggcccgcgactggtactggttgacgccattgatggtcggcccggcgctgtacagcacccgggtgccggcactggagtcctcttcgttgtaatcgccgatccagcgcaggttgaagttctcgttgggcttgaacagcagttggccacggaagccctgccgcgagccgccgttgaggtcatggccgtcgtgttcgttcttgatatcgccgtcgctgcgagtgcgataggccgagaaacgcccggccagctcgtcgttcagcggcccggatatcgtgcccttggtctggaagtagccgtcctcgcccaccgaggtctcgatgctgcgctcgggagtgaagctcggcgcgcgggtgctgatgttgatcaccccggcggtggtgttcttgccgaacagcgtgccctggggaccgcgcagcacttccagctgctcgatgtccatcaggtcgaacaccgccatgcccggccgccccaggtagacgttgtcgatgtacagcccgacgctgccttccaggccgtcgctggccgggttgttgcccaggccgcggatcgacacgctggactggcgcgcatgcatgtaggcgacgttgacgctcggcaccagctgctgcagatcctggatgcgatagacccgctggctctccagggcctggccaccgatcacgctcatcggcgtcggcacgtcctgggcgctctcctcgcggcgccgcgcggtcacggtcacggtttccagctggccgctggcggcgggccgggcggcatcggccttggccggggcttcggcgggcgtttcggcttgcgcggcatagccgtgggaccagccggcgctaccggccagcagcagggccagcggcaggcgcttgagccgtcggggcgaagtgggggacacaaggttcaacgggctcatgggcggctcctgggtaaaaaacagactgatccgtatattcttttaagttatttatttatgtttttaataagatttacggaataagagattgcctttataaagagtcgacctaatgcatagccaatgcatttccccgatattttcaatgtgaaaaatgcatatcgatctgcgccagctccgtcacttcatcgccctcgccgaacagcgcagctttgtcgcggccgccttggcggtgaacctgtcgcaatcggccttcagccgcagcatccaggccctggagcacagcgtcggctgtcagctggtggatcgtgggcgcaaggacctggcaccgaccaaacaggggctggtgctgctcgaacatgcgcggcggctggtcagcggcgcgcagcaactggccaatgagatcagccagttcaacggcctggaggccggcgagctgcgcttcggttgcggaccggcgccggcggcgggcttgatcccccgggccatcggcagctttatcgggcgctaccccaaggcgcgggtgcagttccaggtggatgactggcaaaccctgagcaaacgcctgctcagcgaagagttcgaatttttcgtcgccgacacccggcagttcgaagccaacccggattacctgacccagcgcctgcgcccgcgcaaatggcatttctgctgccgcgccgggcacccgctggccgagcagaaaagcgtcaccgccgccgagctgatgagttacccgctggccgcgaccatccgcccgccgaacctgcgcaaggtggtggtcgatctcagcggccggccggatttcgtcccgaatgtggaatgcgagaacagctacagcctgctcggcgtggtgatgcgctcggacgcgatcggcatcatcggcgcctacagcgatgcgctgcacaatgcccggggcgagctggtgtgcctgaaggtcgaaggcctggccgacgacctggaggagctgtacacccgctacggcatcgtcagccgcgccgggtatcggctgtcgccgctggccgaggcgatgatcgaggagatcaagcgcaccgacgcgctggatgaggatctgtgttcgctggagaatttcgcggtctgaaacaccgcacctgtagccgctgccgcaggctgcgatcgccccgaaggggcgcggcgatttcaatatcgctgaaggccttcggccttatcgcagccttcggcagcggctacagggatcatcttcggcccatgcaggtcgtgcatgaaaagcatgcgccaaatgcgcttgtcggaacgccccgcgacagcgaaaaccctcacctgtctttcgatcggtgaagcccatgtccaaccccgtccaacccgtgcgcaacgtgctgtacatcatgtgcgaccagctgcgtcgcgattacctgtcgtgctacggccacccccacctgcacacgccgaacatcgaccgcctggccgccgccggcgtacgcttcagccgcgcctacacccagggcaccatctgcgggccgtcgcggatgtcggcctacaccgggcgttatgtcagcagccaccaggtggcgtggaacgccgtgccactacccctggaagagctgaccatcggcgactacctgagcccccacggcatccgcaccgcgctggtgggcaagacccacgccacgcccaatctcgatgccctgcagcgcctggcgatcgaccccgggagccagcaggccgaggccctcaacgaggtcggtttcgaaccctatctgcgccacgacgggatcttccccgacagcccgctgttcgacgacaaacgcgagtcggcgccctacacccattacctgcgcgaacagggctaccaggggcgcaacccctggcacgactgggccaacgccgccgcaggtgaacagggtgaaatcctcagcggctggaaaatgcgcaacgcccacctgccggcccgcgtccccgagcagcattcggagactgtctacaccaccgaccgcgccctcgacttcatccaagagcagggcgagcagccctggtgcctgcacctgtcctatatcaagccgcactggccctatatcgcgccggcgccctaccacgcgctgtacacggccgagcaggtgatcgccccggtgcgcgccgccgccgacgaggccagcgaccacccggtgtatgccgcctttcgccagcatcaggagagccagaacttctcccgcgacgaagtgcgcctgaacgtggtgccgacctacatgggcctgatcaagcaggtggacgatcagctcggccgcctgttcgatttcctgcaaagcagcgggcgctgggacgacaccctgatcgtgttcaccagcgaccacggcgactttctcggcgatcactggctgggggaaaaggagtttttactggagccggccgtgggcgtgccactgatcgtgcgcgacccgcgggcggcggcggatatcagccgcggcacgctggacgagcgcctggtggaaaccatcgatgccctgccgacctttctcgacgccctggggctgcccggcgccgaacaccggctggaaggccgctcgctgatcccgctgttgcacggcacggcgggcgactggcgccgctacgccatcagcgaatacgactacgcgttccaggccccggcccgcgaacgcctggcccagcccatcgaccgctgccgcatgaccatggtgcgcagcgaacgctggaaatacctggcctacgacggcttccgcccgcagctgttcgacctctacaacgacccccaggaactgcgcgacctcggcgccgacccggcctatgcggcggtgcgcgaggagcacctggggtatttgttcgactggctgcgcgggctgaagcggcggaccaccatcagccacgaagaaatcgacctgcgcgggcaacgctttcgttatggcgaaccggaggcggaaaaggtggtgcagatcggagtgtggtgaggacgccgctgcgcggctgatcgcgagcagctcgctcctacagggacacggcattgcgcctttctgtaggagcgagcttgctcgcgaaaagtgaggcggcggcttcgcgggcccgattgcccgcgaaaaatttcaaacccaccgcgcactcctgtagccgctgccgcaggctgcgatcgacccgaaggggcgcggcggttccaggatcgccgaaggcctgcggccttatcgcagcctgcggcagcggctacagagagccgtgggacgcctccgtcacagccccttgatggtctggctacgctgcccatgcacacccaccggcacgtcgcccttgagggtcacgcggcggaccacgcggtcctgggtgccgtagtcgtcgaccgcgtaatgctgggtcgaacgattgtcccagatcgccacgtcaccggcggtccagcgccagcgcacggggttttccaggcgcgtgacatggctttgcagcaggttgaacaggtgcgccgaatcggcctgggtatagcccttgatgcgcttgacgaaatgcccgagcaccaggctcttctcgccgctcaccgggtgcacgcgcaccagcgggtgctcggtctcgtagacggtggaggtgaacaccttgcggtagcgctccagcttctccgccgacacgtcgggcttggccccggcgtagtcgtattcgttgctgtgcaccgcccagagcttgtccgccagctcgcgcagctccaccggcagttcgttgtaggcggtggcggtgttggcccagaccgtatcgccaccggaggccggcgccaccaccgaacgcaggatcgaggccttcgggtaggcatcgacgaaggtcacgtcggtgtgccaggagttggcgcgctggccctcggcgccgtccagttcgagcaggtaacgggtgccgtcgcgcaccggcacggtggggtgcgccaccggctcgccgagcaggtgggagaaagcttcctggctctggtcgtcgaggtgggcctggccacggaagaagatcaccttgtagtccaccagcgcctgctggatggcctcgaccgtggcggcgtccagctcgccggagagttgcacgccacggagctcggcgccgatacggccggccaccgggtggatctcaagcgcatgaacagcgggtttaacggctagtgcggcattgctcatcgggtagaccctcgtctgactgcttacggttgagcggcagcgaaacaacgctctatctatattcactttagatctaatagatatttacatgcttcgttgacggaataagagcttgcatttaaaacctcattcctcactcgtcgcaaatgccttcgggctatttttcggatgccgggaaagcatatggatcttcgccagttgcgttacttcatcgccctcaacgaacaccgcagttttgtccgcgcggccgacgccatgggcatcacccagccggccttcagccgcagcatccaaggcctggagcaggagttcggctgcgtgctggtggaccgtggcaacaaggatttgcgccccaccccggaaggccaggtggtgttgcagcacgccctgagcctggtgcagggcgcggccctgctgagcagcgaagtgacgcagatgaccaagctcgacgccggcgagctgcgcttcggttgcggcccggcgccggcggtgaaactggtgcccgacgcggtggcgcaattcaccggcatccaccccaaggtgcgcatctgcctggaggtggataactgggaaaaactcagccgcagcctgagccgcgaagagatcgaattctttatcgccgacatccgccatttcgaagccgacccgaacttccagacccagcccctgacgcccaagcgcggggtgtttttctgccgcccggggcacccgctgctggccaaggaaagcctgtcgaccaacgacatgttcgactacccgctggccaccacgctgatcccgccgggaatccgcaagctgctggccaacctcagcgggcgcatcgacttttccccgaccatccagaccgaacatttcccggcgctggtgaagatcgtgcgccagtccaatgcgattggcgtgggcaccgaagaagccttcgtcgaggacatcgaacaaggctccctggcgctgctgcactggcgcaacctgccgcagaacatcgagagcatgaacgcccgctgcggcatcgtcagccgcacgggatttcgcctgtcgccggcggcccgcaagatgatcgaagtgctggtggcggtggatcggcagcaggtcagcatggcggtttgagccagtagaaaatccccgccaatcccctgtagccgctgccgagcccgcgaggctgcgatcgctctgggcggcactccgtcgcaggggccgcaaaaccatgcaccgcatacttcccggtaaaccgcatggacaggtttggcgaggactgcgtcctcgatcgcagcctcgcgctgcttggcagcggctacagaagcagggcatgccattcgaaatggttgggccgccccgaaccctgtagccgctgccgaaggctgcgatcgacccgggccgcgttcggagaacggtcgcagcgatctcatggccgcaacgggtccggcagaagatcgggaaccaaggtcctgcggaccttatcgcagcctcgcaggctcggcagcggctacaggacgtgagcggattgccaggtggccttacaggccggcggcggccaactgcggcgccacccattcgctgaccttgaacggcttacggatcagccgctgctgcgcggccaggtccaccgcgtcctgcaatttaccgaggaacaccgggtccagggtcgaggggaagatttcgctgaagcgctgatccttgaggtcctgctgcaacaccagcggcgggtagctggccagccccgacaccagttcgatataggcgtccttgttgctgtcctgggtcagccactgcacggcctgctgctgggccttgagcagcttctccacgacctcaggatgggcgtcgacgaacgcgccgctgcccaccagcaccgcctgcacgctaccggcgccgcccaggtccttggtgttcagcggcacctcggccaggcccttggcctgcaaggcgttcaagttggaaccgccccaggtggcatcgatctgcttcgccgccagcgccgcgaccgccgcggtgaaatccaggttgatgatcttcaggtccttctcgctcagaccctggctggccagcgcggcatccagcgacaactgcgtggccgtgccgcggaacaccgcgacccgcttgcccttgaggtcctgcaaggtcttgatccccgagcccggcaccactcccaggtactgcttgaccccacgggcggtggcgctcagcaggcgggtgtccaggccgttggacttgccgatgatcgctgccaggtcccccaggtaggccaggtccacctggccgttggcgaaggcttcgttgatcactgggccggcgcccttgaagtagttccactggatgctgatgccctggtcggcgaaggccttttcgaagatctgctgctggcgcagcacgtccgtcaccccgccgccgctgtgttgggtgccggcgctgaggtccggcacggcgatgcggatctgcttgagttcatccgcctgggccagcagcggcaggtaccccaggagccccgccagggccggcgcggcgaacagactgaggacgcgtttgaagggaaggttcataaggtgtggctcctggctgcgacgggcattgaggagcagaaggtaggcccaaggcgttcaaagctttaaatactataaattcacattttaataactcgttcgaataaaccagccaggacgcggctctgcgcggcgtatgcatgatcagcatcgaaaatattcttcaaatgcattggatgcggcgtgcctggaggccttaaatggcctctcttatctcccaatagcattgatgtaacttttttatataaccaaaaacaaactccaaaaaacaaactgtaagagcgagcttgctggcgataagccgcaggccggttttggccccgatgccgctatcgcgagcaagctcgctcctacagaaagaagacagttgaaatcagcaagaaacccgacaacggagatcgtccatggcccgtgtttcccttctcagcttgccgttggccgcgcccgccaataagccgctgtcctggccgcgcatccaccggcggctgttgccctggctgctgcccctgggcctgttcgccctgtggtggctggccagccgtaatgcctggatgagcgagcagatcctgccggcaccggcattggtctggagcagcgcgctcgagctggccggcggcgagctgtggagccatctggcaatcagcctgcaacggctggcctggggcctgctggcgggcatcggcgccggtgccctgctcggcgcggcgctgggttccagccggcgcctggaacgcctggtgttccccactttctcggccctgtcccaggttccgaccctggcctggattccgctgttcatggtgtttttcggcatcggcgaactgctcaagctggtggtgctggtcaaggccatcgtggtgccggtgaccctgcataccctggtcggcgtgcgcgacgcccagcccaaattgcgcgaggccgccgccgtgctgcgcctgccgccacacctgctgatccgccggctagtgctgcccgccgccctgcccgccttcatggccggcgtgcgcctggccctggccgccggctggacctcgctgctggcggtggagctgctggcctccagcgaaggcatcggctacctgatggtctgggcgcgccagctgttcatgctggatatcgtcttcgtctgcatcgtggtgatcggggtgattggcgtggccatggaccgcggcatcggcctgctggaccaggccctggtgcactggccgcacccggccatcgcgcagatccgccgcggcccgcgctaccagggctggcaacgcctgcagccgtggctgctaccgctgttcctgctggcgctgtggcaagtggcgaaccagctggaatgggtcgacgccaatattctggtgagcccgctggcggtgctgcaaaccacctggaacggcctgctcgacggcagcctgtcgggcggcctgggcctgagcctgcagcgcaccctcggcggcctgctgctgggcggcggcctggggtttgccctgggcctgctgctgggcctgtcgcctctgagcgaacgggttctggggccgaccctggcggcgctgcggcagatcgccattttcgcctgggtgccgctgctcaccgcctggttcggcctcggggagctggcgaaatgggtatttgtcgcgctggccgcgttcttcccgctgtttatcgccacccagcgcagcgtcgccaacctgtcgccgcaactgaccgaggcggcacaagtgctgcgcctgagcctctggcaacgcctgcgccgcctggtgctgccgggcgccgcgccggggatcttcgccggcctgcgcctgagcctgatctacgcctggctggggaccatcggcgcggaatatttcatgccgtccaacggcggcatcggcagccagatgatcggcgcccagcagctgctgcgcatggacctgatcatggccggcatgctcctggtggggctcaccggcgccctgctcaacctcattggccaacagctcgaaacccgcgccacacgctggagacacgcatgaacgcacccgcaccttcccccatcgtcagcttcagccatgtgggcaagaccttcgaggtcgccggcggcgagctggaggcgatccgcgaattcaacctggagatcgccgagggcgaattcgtcgccatcgtcggctccagcggctgcggcaagtccaccctgctgcgcctgctgatcggcctggatacgcagtttcgcggcgagatccgcgtcgacggcaaggccgtcagcggcatcggcggcgaacgcggcatcgtgttccaggaacaccgcctgttcccctggctgacggtcgcggaaaacatcggcctgggcctggtcaacgaagccctgagcgccagcgaacggcaaacccgcatcgccgatttcatcgaactggtgggcctcaccgatttcacccgcgcctacccgcaccagctgtccggcggcatggcccagcgggtggctatcgcccgtggcctggtggccagcccgcgcatcctgctgctggacgaacccttcggcgccctcgacgcgctgacccgccagcagatgcaggacgagctgctggcgatccgcgagcgggccaggatcaccacggtgctggtcacccatgacgtcgaggaagcgatcttcctcgccgaccgcgtggtggtgatggaaccgcgccccggccggatcaagcgggtggtggacatcgccctgccccatccgcgccagcgcagcagtttcgacttccaccagctgcgcgaagaactgctccacgaactgaccagcgacgatcactaccaggtgcctttgcccgcccagatccgtgacctgccactggcctttattgcttgctgataaggagtgaataaatgccgcaacgtcccaacttcctggtgatcctcgccgacgacctgggcttttccgatctcggtgccttcggcggcgaaatcgccacgccaaacctcgatgccctggctttcaacggcctgcgcctgaccgacttccacaccgcgccgacctgctcgccgacccgttccatgctgctcaccggcaccgaccaccatatcgccggcatcggcaccatggccgaggccctgaccccggaactgatcggcaagccgggctacgagggccacctcaacgaccgcgtggtggccctgcccgagctgctccgcgacgccggctaccagaccctgatgagcggcaaatggcacctgggcctgaccgccgagctggcgccccatgcccggggtttcgagcgttcgttttcactgctgcccggcgccgccaaccactacggtttcgagccgacttacgacgaacacaccccggggctgctcaagtccaccccggcgctgtacatcgaggacgaccgcttcatcgacccattgcccaaggacttctattcctccgacgccttcgacgacaagctgctgcagtacctcaaagagcgcgaccagacccggccgttcttcgcctacctgccgttttccgcgccgcactggccgttgcaggcgcccgaggaggtggtcgccaagtaccgtggccgctatgacgccggccccgaagtgctgcgcctggagcgcctggaaaagctcaagcaactggggctgatcgaagccgatgtggaaccgcacccgctgctgggcctgagcgccgaatgggcggccttgagcgagcagcagcggcaggtttccgcgcgggccatggaggtctacgcggcgatggtcgaacgcatggactggaacatcggccgggtggtggactacctgcgccagcagggccagctggacaacacctttatcctgttcatgtccgacaacggtgccgaaggcgcgctgctggaagccttccccaagttcggcccgcagcttttgacctacctcaaccagcactacgacaacagcctggacaacatcggccgcgccaactcctacgtctggtacggcccggcctgggcccaggtcgccaccgcaccgtcacgcctgttcaaggccttcaccaccgaaggcgggatccgcgtgccggcgctggtgcattacccgcagttggcgctcaagggccggatcagccatggcttcggcacggtgatggacatcaccccgaccattctcgacctggccggcgtgcgtcatccgggcaagcgctggcgcggcaaggaggtggcaccattgcgcggcaagtcgtggctgggtttcctgtccggcgaaacggcgcaggtgcatgacgaacacacggtcaccggctgggaactgttcggccgccgggcgattcgccagggccagtggaaagcggtgtacatccccggcccggtgggcccggcgacctggcagctgtacgacctgagccaggacccgggggagatccacgacctggcgcagcgcgagccgggcaagctcgaggcgctgatcggccattggcagcaatacgtggacgaaaccggggtgttcctcagcgcctcgccgttccagccggattgatcctgtagccgctgccgcaggctgcgatggtccgggccacgctggtcgcaggacctcctagggccttgagatcgccacggccgttccggccgatcgcagcctgcggcagcggctacaggtgggggaaaacgccgaaggttgcacgtctgcggaatcgccatcgcgagcaagctcgctcctacaggttatccatgtacttgtaggagcgagcttgctcgcgattggccctcaaacgcgatccatcacgccccgactccccgcaccgcctgcgccgccacccgctccttgcggataaagcggttggcccggccgaaggtgccgaaatcgttgaagcgcacgcccatctcggccatcaccttgtgcgccaccggcgcggtcagctggcggatgtagaagggttccttgaccacgaaatggtggatgccatgggtgctgccgaaattgaagcagaacgcctgcaacggccacagccaccaggggttgagcacctgggtctgctggatcacgttgcccgcttcgatgtcgccgtagtagtgcatgttcgaactgacgaagtgcaggcaaaaggtgcgcagcacattggggccgatgatcaccaccacagcgatatcgagcacctgcatcactgccagggtgctggccgaccagtcgatgggcgcgcccagcagcgcggcgacgccattggcggcgtggaagccaaggaacacataccaggccccccagtgcaacagcgccagcggtgcgtacaccttgagggtgcgcttgaggatattgagcttgtgcgcccaggtcctggcgcgcagggtgcggatcaatgacgacatgacattgtcgccaaccatcagcaggcgggcgatgccccagggctcgccgttggtgatggcgcgctcttccatgtcggcctcggtgccggacaccttgtggtggttgaggtgcaaatgacggcggatccacgggttgatggtactcggccgcgccagccagaccagcgccagcatcaggttgtgggggatgcgctgcttgcggaaatacatgctgtggatcaggtcgtgttccagctcgtgagtcaaggaggcgaaaaacgcgttgagcagcaggcaggcccaccaggccaggtacccaccgatatagagcgccgccgtgccgatcatcccggccagggccaaggccaggatgcccgcgcccagcgcgtcctgatgcttgagcagcgggtagcgctcgcgcaactcgacgcccctggccagcaccacctcacgaatatgcgccgatcgttgctgagcattcagccggtcgggacttgcagaagtaccgtacatgcttccatcctctggttattgatgttcgcatcctgccctgcgcccacgcgccgggcgctagccgcggacgccaacctgttgaccggacgcgccaaccgccatgaccgaacccacttccctcgccagctggacccgcgccctgcgcaagcagctcgatgccctgggcctcgacagcacagccctgtgccaccaggccggcctcgacccacagctgatggacgatcccaacacgcgttacccgctgtcggccaccacccgcctgtggcagctggcggtgcaggccagcggcgacccggccataggcctgcgggtctcgcgcttcgtcagcgaccaccttccatgccctgggttatgcgctggtggccagcggcagcctgcgggaagtgttcgagcgcatcgtgcgttatcaccaggtggtcagcgacgccctggagctggagctgacccgcaccgaggaccgctatcgctttcgcctgaaggtgcctaagggcaacccggagccggcggtcgaggccatcgacgcctttgtcgcgatctacgtgcgcacctgccgcaaccgcctgggccgcgactacgcgccgctggcggtgtacctgcggcgccccgagccggcggaccccaggcaatggcacacggtgtttcgcgcgccggtgtttttcggcgccgacgaggatcgcctggagttcggcctgcacgatttcgacagccacctggacgatgccaacccggaactggccgaacacaacgaggcggtgctcaagcgcaccctgatgcaactgcaacctttgacctgggagcgcaaggtacgcggggtgatcgaggcccagctgccggaaggcgagccctcggccgaacgtgtggcccaggccctgcacctgagcctgcgcagcctgcaacgccacctggcggacgagggttgtcgcttcgacaccctgctcaacgaatgccgggagaacctcgccctgctgcacctgcgcgacccgcaatgctccctgagcgagatcagctacctgctggggttcgccgacgccagcagcttcagccgcgcgttcaagcgctggaccgggatgaccccggggcagtttcgggatgggttgcgttaggccgggattggcggagacagtgccggccttatcgcgagcaagctcgctcctacatggacagtgcaggtccttgtaggagcgagcttgctcgcgatagcgatctaaagatcaaaccccggccaagatccgcaagcggtcctcgtcgaggatctcgatctcgccgtaacccagcttgagaatgccctggccctgcaagtccttgaggatctggttggtggtctggcgcgacagcgacagcagcagcgccagttgctcctggggcaggtgcaggacccggcgcggggtgtcggtctcgccgtagccgcgggcgatcatcaacagccggttggccacccgcgccggggccggcatcaggctcagctgttcgaggttgataaaggtcaggcgcagtttatggctcatcaacagcgccagctgccgccagtattgcgggtgttcgtccagcagttcgagcaacgccgcctggggcacattgagcaggctgcacgggcccacggcataggcgtcatgggtgcgcggctggccgtcgaacaggctgatctcgccgaaccagtgcggcgcctccaccaggctcagcagcgcctccttgccctcctcgctgaccgcgccgatgcgcaccgtgccttccagcaccgcgtacaggccgcagggcggatcgccacgctggaacagccgttggcccggcgccagcgagcgtaaacgggcattggccagcagactattctgtaattgaacgggcaagcggctgaaccactggccactcatcaggcgctcacgccagacctgcatcttcatcgattgcgttatccaaacaggcagcgagccgattgtcgcctagccgacagaaccggcgaccggcgcagggcatgattcgatcaccctacaggaggaacaaccatgaaaagcctcgtcgaccatctcagtcaatacgccgcctaccaccgtgatccgcgcaacatcgccagccactttatcggcattccgctgattgtgctggccgtcgccgtcctgctgtcgcgccccgcctggccggtcgccgggctgtggctgtcgccggcgctgctgctggcgctggcgtcgtgcgggttctacctgcgcctggaactgcgcctgggcctgctgatgacgctgctgatggggctgtcggtgtgggctggccatgcactggcgcaacaaagcaccctggtctggctggccagcggcgtgggcatattcgtgatcggctgggtgatccagttcgtcggccactactacgaagggcgcaagccggcctttgtcgatgacgtctcggggctgatcgtcgggccgttgttcgtggtggcggagctggcgtttctgctggggctgcgccagacactcaagcatgaaatcgaggcgcgagcgggaggggtgcgggtcaatccgaagcgtgccgctgtttgaaatggctatcgcgagcaagctcgctcctacaagggatggggttgaccataagttcatgggtcatccccggatcattgtaggagcgagcttgctcgcgatgctttcggcttttagatattggcgaccttctgccagaccttgggcttgaagaacagcgtctcgcccttggccagcccgaccaggctgtcatggtctttcaccacttcggcctcgatcagttcgctctgcccttcgaccttcaaggtcacccgggtggtcgcgcccagcggacggatatcgcgcacttcggcggcgtggtgatcggccagttcggagcgcgacagcgacacttcgtgcgggcggaacagcacatggtggtcctcgcccaggtgcaggcggttggagtcgccgaggaagtggtagacgaagtcgctggccgggttctcgtacacctcgcccggcgagccgatctgctcgatcacgcccttgttcatcaccacgatacggtccgccacttccatggcttcttcctggtcgtgggtgacgaataccgaggtcaggttgatgtcttcgtgcagccgcgccagccagcgccgcagctccttgcgcaccttggcatccagggcgccgaagggttcgtccagcagcagcactttcggctccaccgccagggcgcgggccagggcgatccgctggcgctggccaccggacagctgttccgggtagcggtcggcgagccagtccagctgcaccatgttcaatagctcatggaccttctcggcgatcttgctttcgctcgggcgctggtttttcggcttcatgcgcaggccgaaggcgacgttgtcgaacacgctcatatggcggaacagcgcgtagtgctggaacacgaaaccgacgttgcgatcgcgcacgtcgtggccggagacgtcctcgccgtggaacacgatgctgccggcgtccggggtttccaggccggcgatgatccgcagcagggtggtcttgccgcagccggacgggcccagcagcgccaccagctcgccgctctggatgtccaggttgatgctgttcagggccttgaaggcgttgaaattcttgctgacgttacggacttcgatcgacatgattcattcctccgcggcgctggcgcgcaggcggttgatacggttttcgctccactgcttgagcagcaggatgaagagcgccaggatcagcaacaggctcgcgacggcgaacgcggcgacgtggttgtattcgttgtagaggatctcgacgtgcagcggcagggtgttggtcaccccgcgaatgtgcccggaaaccaccgacaccgcgccgaactcacccatggcccgcgcggtgcagagcaccacgccgtagatcaggccccacttgatgttcggcacggtcacatgccagaacatctgccagccgttggcccccagcagccgcgcggcttcctcttcctgggtgccctgctcctgcatcagcgggatcaactcacgggcgacgaagggcacggtgacgaagatggtcgccaggacgatgcccggcagggcgaacacgatctggatatcgtgatcctgcagccacggtccgaacaggccctgggcgccgaacatcagcacatagaccaggccggcgatcaccggcgagaccgagaacggcaaatcgatcagggtcaccaggatgctcttgccgcggaaggtgtatttgctcacgcaccaggcggcgctgacgccgaacaccaggttcagcggcaccgagatcagcacggcgatcaccgtcagcttcagggccgacagcgcgtccggctcgaagatcgcggcgaagaacgcgccgaggccgagcttgagcccctgggacaccacgatgaacagcggcagcagcaggaacagggcgaagatcagccagccaaggccgatcaggatgcgccgcgaggtggcgctgccacgacggtcggcgttggccgaggaagcggcgctaatggacgattgggacatggttcgcgcctccttaaggtcgttcgatgcgccgctgcagcaggttgatcagcagcaacaggacaaaggaaaccaccagcatcaacacgccgatggaggtcgcgccggtgtaatcgtactggtcgagcttgaccatgatcagcagcggcaggatttcggttttcatcggcatgttgccggcgatgaagatcaccgagccgtattcgccgacgccccgggcaaaggccagggcgaagccggtcagccaggccggcagcagcgccgggaccaggatgtggcgaaacacctgccagggcttggcgccgaggcaggcggcggcttcttcgacctcacggggaatgtcggccagtaccggctgcacggtgcgcaccacgaacggcagggtgacgaaggtcagcgccagggtgatgcccagcggggtgtaggcgatcttgaaccccaggtcggtggcgaactggccgaccaggccggtcggcgcgtacagcgcggtcagcgcgataccggccacggcggtgggcagggcgaacggcaggtcgatcatcgcatcgatgatcttgcgtccgggaaagctgtagcgcaccagcacccaggccagcagcgtgccgatcacgccattgatgatcgccgcgtacagcgccgtgccgaagctcagcttgagcgcggcgagcacccgcggtgccgagacgatggcccagaactgatcccaggtgagttgggcggcatgcacgaacatcgccgccaggggtatgagcacaatcaggctgaggtacaccaaggtgtagcccagcgtcagcccgaagccgggtatgacgggggagatacgacgcgacataaaagtccttggttagcgggtagataccattgtaggagcgagcttgctcgcgaagaactcaagggcaccgcgctcaatcagaatgtacgcgttatcgttgacgatcttcgcgagcaagctcgctcctacaggtagtgttgcttactgcgcctggtagatctggtcgaacaccccgccatcgttgaagaatttcggctgggcagttttccagccgccgaagtccttgtcgatggtcaccaggtccagtttggggaactgctgagcgtatttggccgcgacgtccttgtcccgtggacgatagaagttcttcgccgcgatctcctggccagccgggctgtacaggtgcttgaggtaggcctcggcgatctcggtgttgccctttttctcggcgttcttgtccaccaccgccacgggcggctcggcgaggatcgacagcgaaggcaccacgatgtcgaacttgtcggcgccgccgtcttccttcaatgccaggaaggcttcgttttcccaggccagcaacacgtcgccctgaccgttgttgacgaaggtgatggtcgagccgcgggcgccggtgtccagtaccggtacgtgcttgaacagctccttcacgtattcctgggcacgggcttcgctgccaccggctttcaggccataggcccaggcggcgaggaagttccagcgggcgccgccggaggttttcgggttcggcgtgatcaccgacacgtctttcttgatcaggtcgccccagtccttgatgcccttggggttgcccttgcgcaccaggaacacgatggtcgaggtgtagggtgtgctcgcatccggcaggcgtgtttgccagtcggccggcagggtcttgccgagcttggcgatttcatcgatgtcgccggccagcgccagggtcaccacgtcggcgcgcaggccgtcgatcaccgcgcggccctgcttgcccgagccgccgtgggattgctggatcttgacgttgtcgcccgggtgttcctttttccagaagcttgtgaattcgctgttgtagtcctggtacagctcgcgggtcgggtcgtacgacacgttgagcaactcgtaatccttggcaacggcggaaccggcaaaaacggcgctggcgagggcggccagggcataacggcgaatcgacgacatgatggagctcccgaaattttttaatgtgctggcatttttcttatggcgaatcaggcccgcattcgtgtgcgaacgctggggttcaggctgggggtcatggatgacgccctccggtggtccagtcgggcctctcgtgcgagaggtggtgcgaaattcagcttggcttgttgccagggttttgcaggcggaatttttccttgcgttcgatctgcacgacctgggcgttgtgcacggtgatttccaccgcgccgaaacgcaggtcgcgcaatgcgctttgaatctcgcgcaagatggtttgttcgtcctggccgtcaacgctacgaagagatgcgctcatggtgttgctcctgaatgagatgtgcctggcagtggcggcactgcttgcggcgtgagggcaatagtagataggcgcagatattcttaaaaatactatttaagaatgtttatataaccagaagaaattatttgaattgacgcggggttgcgtctcttcaggcggcagaaaaccttgtagccgctgccgcaggctgcgataagaccgcagctcctcctgcgtccttgcgagcgccacggccattccggccgatcgcggcctgcggcagcggctacagggtggaatcgatgcaagcctggcaatcagtggatctgcggcacccgcccccattccagctgcgccgccggcaccgggcggccgaaccagtagccctggcccaggtcgcagccctggtcgaggaggaagcgcgcctgctccacctgttcgatgccttcggcgtgcacttgcatgcccatgctctgggccagggcgatgatcactcgggagatcgccgcgtcgtcttcgtcccccggcaggccggcgacaaaaccctggtcgatcttcagcttctgcaccggcaggcgcttgagccgcaacaacgaggaataaccggtgccgaagtcgtcgatggccaggcgcagccccagttcgcgcaggcggtgcatctgctccagggccacttccgggtcttccatcaccgcgctttcggtgacttccagctccaggtaggccgggtccaggccggtgtcgtgcagcacctgggccacctgctggtacagctcgcggcgggcgaacaggcggctggagacattcaccgcgacgaacgacaacgccatgccctccgcctgccattggcacatctgccgacaggcctgctgcatgacccaggcatcgatctcggcgatcagcccggcgcgctcggcaatcggaatgaactccccaggcggtaccaggccgcgctgcggatgctcccagcgcaccagcgcctcgaccccgaccaggcggctgctggcaaggtcgtgcaccggctggtagaacacccgcagctcctgctgctccagggcgcggcgcaattcgaaggcaatttccacccgttgctgggcgtgggccgtcagttcctcggtgtacagcgcgtaactgtcgcgcccggcgctcttggccttgaacagcgccgtgtcggcattgcgcaacagttgctcggcgctcagggcatcgctgggaaacaggctgatgccgatgctggcattgatgaacagctggttctcgtccattaggaagggctgcttcaccccgtcgtatgatgcgctgcgccagcaccgcggcctgccctggctgcgcgcagctctcgaccagcaccgcgaactcgtcgccgcccagccgcgccagggtgatgcccggcccgaacatgccttgcaggcgctgggccacggccttgagcaggcggtcgccgacagtgtgcccaaggctgtcgttgatcatcttgaagtggtccaggtcgaccatcagcaacgcgcagcagcgcttgtggatttgcgccgacgccagggcctgctcggcacggtcggtgaacagcaagcgattgggcaggtcggtcagcgggtcgtggtgcgccaggtgggccagttcgtgttcggaatccttgatcgcgctgatgtcggaaaacaccgcgacatagtggctgagctggccgtcgtcatcgcggatggcgcggatggtctgccactgcgggtagatctcgccgcatttgcgccggttccagatctcgccgctccactcgcccgtggcgttcagcgaatcgaacatggcctggtagaaatccgccgtgtgatgcccggacttgaacaggctcggctggcggcccagcacctcgtcgcgctgatagccggtgatctcgatgaacgcgcggttcacgtggacgatctggccccggcggtcgctgaccagcaccccttcgcgggtgcaatcgaacacggcggccgcctggcgcagacgctcgcggtcctcgcgctggtgatgccgccaggagtcggcgcccagcaaacgcaacagacggccccgcgcgatgaagatcaggaccgcgctgaccagggcccagagatacccgttgatcagttgccagcgcgccagatcgttcgactcatcgaagaaactgctcaataaatgaccactgaactgcagccacaccacagacagcaagagatagagcagggctgcgcgcaaagcgtcgcgggaagaaaccgacataaggtcgtcaatgtccttacgaaaagcttggaattatagaggaagaaacatctcgccactcttatctgaaagggcgactggttttctctgtgggctcggtgataatgcgactgctgttttttctttatcgagggccctacagcctatgtggtacgaaggttttcttggcttgtcggcctggcaactggtggcagtcaccctgttaatgactcacgtgaccatcgttggcgtcacggtttacctgcatcgctattcagcccaccgctccctggagctcaatgccggcctgaaacatttcttccgcttctggctgtggctgaccacggcgcagaacacccgcgagtggaccgccatccaccgcaagcaccacgccaaatgcgaaaccgaggatgacccccacagcccggtgatcaagggcctgtccacggtgctgcgcaaaggcgccgagctgtaccgcgaagaggcgaaaaacccggaaaccctgcgcatctacggcaagaactgcccggacgactggatcgaacgcaacctctactcgcgctacaagctgggcggcgtggcgctgatggcggtgatcgacctgctgctgttcggcaccatcggcatcaccatctgggcgatccagatgatgtggatcccggtctgggccgccggcgtgatcaacggcctgggccacgcggtcggctatcgcaacttcgaatgccgcgacgcggccaccaacctggtgccctggggcatcctggtcggcggcgaagagctgcacaacaaccatcacacctaccccaactcggccaagctgtcggtgaagaagtgggagttcgacctgggctgggcctggatcaaggtgttcagcttcctgcgcctggccaaggtgcagcgggtcgcgccgatcgcccaccgggtcgaaggcaagggccacctggacatggacacggcgatggcgatcctcaacaaccgtttccagatcatggcccagtaccgcaagctggtgatcgcgccgctggtcaagcaggagctggacaaggtcgatcactcggtgcgccaccagttccatcgcgccaagcgcctgctgtcgcgcgagaccagcctgctggaagagcgccaccatgcgcgtatccagaacatgctggagcacagccaggccctcaaagtgatctacgaaaagcgcctggcgctgcagcagatctgggccaagaccagttccaacggccacgacatgctggcggcgatcaaggactgggtccacgaagccgaggccagcgggatccaatcgctgcgtgactttgccagccagttgaaaacctactcgctgcgccccgccaccgcctgacgctggcccgttcacccgccatggcgagcccggctgccgtggcgggtgggcttcgctgcccaccccgccccatgagttccagcccgtcatccgtgccaccgtgaccgcccagcggctgtcggctcccagaccgcggcaaacgggaacttcgccgccaatcccctatctcaagcaacacttcgccatccaggcgggctttccgtggccgcttcgtttcccgagcggcgtgcgctttgagatcggtgccgatggtcaacaagaacccacaactcccatccgcttttccccagtggcccgaggccgcgcaaaccttgatggcgctgatgcatgcccagggcgaggtcgcccggctgacagaacgcgaacagctgttcagctcgttgctggtcagcgtcaatgccgtgctctgggccttcgactgggaagcccgccaggtgctttacgtcagcccggcgtatgaacgcattttcggccgctccgccggcctgctgctggccgacgccaacgaatggcgcgacagcgtctaccccgacgacctcgaatacgccgagcggaccctggctcaggtgctggaaaaaggcgcggtggaagaccgcgaataccgcatcatcgatgcccagggcaaggtccgctggctcagcgacaagtgcttcatcaatcgcaatgccgcccccggggaccgggtgatcatcgtcggcctggccgaggacatcaccgagaaaaaggacctggaaaccgagctgcaacgcctggccaccaccgacgtgctgacccagagcagcaaccgccggcacttcttcgaatgcgccaaccgcgaattcgagcaggcgcgccagcaaggcacgccgctggccttcctgttgctggatatcgatgacttcaaggtggtcaacgatacctacggccaccccgagggcgataacgtcctgcaacgcatcgccgagaccggccgcgcgaccctgcgccgtggcgatctgttcgggcgtatcggcggcgaggaattcgccgcccttttccccggctgcgccccggacatggcgcgccaggttgccgaacgcctgcagcgggaaatccagcgcctgaccttcagccatggcgaggagcagttcagcatcaccgtcagccagggcctgaccagcctcaccgccgacgacgaaaacctcgacagcctcttcgcccgcgccgacgcggcgatgtacgaagccaagcgccagggcaagaaccggatcgtttcggggtagctcgcaactgcaacccaccgtagccgctgccgagccccgcgaggctgcgatcgatggcgtagccatcgccaagcaggctccgcgttacatcaggtacaccgcgtgcgctggttttgcggcggctgcgccgccgatcgcagcctcgcaggctcggcagcggctacgaggtacggggggttcatgaattggccaaacacaataagagctgcgaaaagaggtactgcgaaagctcagcacctcagccggctgcgcacctgtagccgctgccgagcaacgcgaggctgcgaacgatggcgcagctatcgccaagcaggctccgcgttgcatcaggcacaccgcgtgcgctggttttgcggcggctgcgccgccgatcgcagcctcgcaggctcggcagcggctacgggattgcgcggtgtcctcacgcttctcgcgtatcggttttacgcaggcgaaccagctccggcaggccgatcttgagcaggcgtgcggtcttgctgtcggccagctcttcgaggccctcggatggctgcaggcgggcgagctgggcggagaggttcatcaccagggcctcgcgggagtaaaccccgccaccgagctggtaggccgaggcaatcagctcgcgcagctccagcggcaggcgccagcgggtgcgcagggccgaaccataggccgcgccgaactgtgccagggcatcgccgatctcttccatgtcgtccagcgcgccaccggcctgcttccactcttgcaggcaacgcagcagcgccagatcccccaggcgatgcagcatgccggcgcaatagcagcgttcctggtccaggtccagcaagcgggccagggtccggccgtattccgcagtgtgcagcgacagctcccagtaacgctcggcgtaatcgcccagggccgggtcgctcaggcgcgcgctgcgcttgagcgccaggccgagaatcaggttcatgctctgcccggtacccagccggtggagggcctgggccagggtctgcaccgcgctaccatggtgctgggcggcgctgttggccgcggcgatcaacaccgcgttgatctgcgggtcgctacgcacctcttcttccagcagcttgaggtcgagaccgttggggttgaggctgcgcttcaccgccagttgcacatcggcgagcaacggcgcgccgtcggccagctcgcggcggcgctcgagaaaggtccacagggtcatgcccggcgccagggtcggcacctcgcacgacacttcctggccggggtccagcagcaggtcctgcaggcgctgggtcaggccttccatgttcagcggcttggtcaggtaggccgtcggcgccagcggcagggcttcgcgcacgctggcgctgtcgttgcggctactcatgaggatgaacggcagcaccgggttgcgcttgcgctggcgcacgctacgcagcaggcccaggccgtcgacgccgggcaactcccagtcggcgatcaccaggtcataggggttttcggccagcagttgcagggcttcctgaccgtcggcgcacacatccagccgcgcgtcgcaacgtacattcaacaacacctgcttgagcaaatcgcgcgaccaagggtccgcctcggcaatcaacactcgcggtacagcgggtaaatccacagcagtcatgcagcacgctccctgggcaatcccttgcaccttagtcaatgccgaggcttgcatacaacgcaaatgcactgcgcagcctcgttcggcacaaaaaaacccgccaaagcgggtctttttgtcgatcgggtcacaggcaggatcagagctcggagaagcactcttcgatgatcgccaggcccttgtccagctgctcgtccggcgaggtcagcggaaccagcacacgcaggacgttgccgtaggtgccgcaggacagcaggatcaggcccttgtcgcgcgccttggcaacaacctgtgccacggcggccgcgttcggcttgtgactgtcgccgttctcgaacagctcgaccgcgatcatcgcgcccagggcacgcacgtcgccgattaccgggtacttggcctggatggccttgaggccggtcaccagacgctcgccgaccgccttgcaacggtccagcaggtgctcttcctcgaacacttccatcacggccagggccgcggcgcaggcgatcgggctaccggcgtaggtgccgcccaggccgcctggcgcgatggcgtccatgtattcggccttgccgcagacaccggccagcgggaagccgccagcgatggatttggcgaaggtggtcaggtcggcggcaacgcccatctgttccatggcgaagaaggtgccggtacggccagcgccggtctgcacttcgtcggcgatcagcaggatgccgtgctggtcgcacagggcgcgcagacgcttcatgaactctttaggcgcgacgtagaaaccgccttcaccctgcaccggctcgatgatgatcgcggcgatgtcacgtggctcggcatcgttcttgaagatgcgctcgatgctggcgatcgaatcgtcgatgctcacaccgtgcagctcgttcgggtacagcgcgcggaagatgccgcctggcatcaggcccatgccggccgagtaaggcacgaccttgccggtcaggcccagggtcatcatggtgcggccgtggtaggcgccggtgaaggcgatcacgccggcgcggccagtggcggcacgggcgatcttcaccgagttctccacggcctcggaaccggtggtcaccagcagggttttcttggcgaaatcgcccggcaccttggcgttcactttttcgcacagttccacgtaaggctcgtaggccaggacctggaagcaggtgtgggtcagcttgttcagctgctcggtcaccgcggcgacgacttttgggtgcaggtggccggtgttgagtacggcgatgccgccggcgaagtcgatgaactcgcgaccttcaacgtcggttaccgtagcgttcttcgcggagtcggcgaagatcgggtgaatctggccaacaccgcgcggtacggcggcttcacggcgtttcatcagggatgcgttggtcttgctcatagtgtcctcattcgccgctcatcggtcggcgtggttcaaggatgacgtggcggggaggcaaccgcggcagcatgcgatgatcgactgccccggctatcccggccactaactgaaagatcgtttaaagcgacgccaggggacagcgctctcgtgcccctggcgtttaaaaccatgccttggcgcgggtatcagatgcccaggcagaggtatttgatttccaggtaatcctcgatgccgtacttggaaccttcacggcccaggccggaggccttgataccgccgaatggcgcgacttcgttggagatcaacccggtgttgacgccgaccatgccgtattccagggcctcggccacacggaacacacggcccaggtcacgagcgtagaagtacgaggccaggccgaactcggtgtcgttggacatcgcgatcacttcggcttcgtccttgaaacggaacagcggcgccagcggaccgaaggtctcttccttggccacggccgcgtctttcgacacgttgaccaggatggtcggctcgaagaagttgccttccatcggcttgccaccggccagcagggtcgcgcctttgcccagggcgtcggcgatgtgttcctggaccttggccacggctttttcgtcgatcagcgggccggtggtggtgccttcttccagaccgttgccgatcttcagcttggccaccgcgactttcagcttctcggcgaaggcgtcgtagaccgaatcctggatgtacaggcggttggcgcagacgcaggtctggccgttgttgcggtacttggagatgatcgcgccttcgacggccttatccaggtccgcgtcgtcgaacacgataaagggcgcgttgccgcccagctccagggagactttcttgatgtccttggcgcattcggccatcagctggcgaccgatttcggtcgagccggtgaaggacagcttgcgcacgatcgggttgctggtcagctcgccgccgatgtcgccggcgctgccggtaaccacgctcagcacgcctttcggaatgcccgcgcggtgcgccagttcgaccagggccagggccgagaacggggtctgcgaggccggcttgatcaccatggtgcaaccagcggccagggccgggccggccttacgggtgatcatcgccgccgggaagttccacggggtgatggccgcggtcacgccgatcggctgcttgatcacgatcaggcgcttgtccggctggtggccgggaatcacgtcgccgtagatgcgcttggcttcttcggcgaaccattcgatgaaggaggcggcgtaagcgatttcgcccttagcttcggccagtggcttgccctgctccagggtcatcaggcgaccgaggtcgtcctggttttcgatcagcagctcataccagcgacgcagcttggtcgcccgctccttggcggtcagcgcgcgccaggccggcagggccttgtcggcggcttcgatggcacgacgggtttcggcagcgcccatcttcggcacggtgccgaggatttcgcccgtggccgggttgttcactttgatggtctggccgttatccgcgtcgacccaagccccatcgatgaaggcttgctggcggaacaactgggcgtctttaagctgcatgtcggtttccttaacagcaccgcgcggggcggagcgaattgtgattgttgaaaggcgccttgacaggctgccgtcaggaaaaactgttaccgggctcaagcacaaaaatagcgcctgtcagaatagacgggcggatcggctctcagacaagagcgtttgaaatctcaaacgaatcctagggtcaaccaggggacagggcaataggctgttcgaaaaaaagaacgaaaacgccgctttggcagaatctttcggatcaacgacaccgccccggcgattgccccctctgtaggagcgagcttgctcgcgatggcggcctggcggccgacatgggtgtcgaatgggcgttctttatcgcgagcaagctcgctcctacagggggttgggcgtgccaaacgcaaaaaaccccgcagccggaaggctgcggggttgtcccagggccaggccttaggtgaacgacttgaggatcgtcagcaggctggcgaggttgtcgccgacaccgccctgggccattttttcggtggccgccgcgcctgcggtggtgttgacgctgtagatctgcatcacgccctggttggtcgccgcctgggccagggtgttttgctgttgctgggccgagaccgagttctggaacaggatcgctacggattgccccagggactggtagatggtgcccatcgacatggccggcgcttcggccacgaccttgacgttggtctgggtcacggcgtcggtgatttgcggactgactgtactcataggtgaaactccttattaagaaagaacaacttccgttagcgctcgcccgatcaagggttgaacgatttgaggactgtcagcaggctggtcaggttgtcggccacgccgccctgggcgactttttcggtcgccgccgcgccggcggtggtatcgacgctgtagatctgcatcacgccctggttggtggcggcctgggccagggtattttgctgctgctgggcggaaacagcgttctggaacagaatcgccgtggcctggcccatggactggtagatggtgctcatcgccatcgctggggattcggccaccactttgacgttggtctgggtgaccgcgtcggtaatttgctcgttgactaatggcatggttcaacttcctttgtttagtacacggcgggttccgtgttaaccaatgaacgtggcaaaacacaggctgtgaacgagcaaatgctcaatggtcctgcggcgcgtcgcctgcctggtcgatacgggaaagcaccgcatcgacctgctgcaccagccccagcatccgcgcttgcacggcttcctcgacagtctggcggatcagctggttctgcgcgctgctgagcatccgcacaggctcctccggcgcatcgataaccgtcgcctgttgcttggccgccagccactggcggatcaccgcttcacgttgctggggactgcccagcaggctgctttcgctgaccctggcctgctccatcaagtcgcgggtgcgttgtctctcgctctcgatcaaatgctgggtctggttgagcacccgctccatgacacccgtgcgcggctcgctgcgcatccaggcttcgagaatctgcttttcgcccggggacaggctcaggttgagcgcatcggccaattgataaagactcgctagcgagtcggaattttcctggggcatttcggcctcctccttgctcattaaagaacgtgctgctgcccagtcccggagggctccgggaccgggtgttcatgacgccaggacggcgtgactcaggacggcggcgcgccgcgattggccagggtgttgctgtacttggcgatgctctcgtcgatcttgtcgatggcaatacccgccgccgtcgcctccagggcgccggcggccgcggcaacggcggcggccgcccccaccagcagatcggtggccagggcgcccaaggcgtcctcggcggctttttccggatggttttcgacgatgtttttcgtcatctgctcgagcaataccgcctgggccgccagcgccagcttgctgaccccgtcgaaatagcccgccgccgattgcgcgaccaggccggcggcctggctgatcatcatgtccggggcaatggcgatctgcgccggggcgtagctgaaggtctgcgcgttggtgaactgcaccgcctcgacgatctggctgttcagcgcatcggtgctgccggtcggcggcgccgcgacctggaccatcatgtagtcgttcatgcggtccatcaccgtgcgcggcgacttgctgggaggactcggtggcggggagtcgcccgctggggtgggatcggcaacctggggccccgcagccgtaggctcggcggcttcggaattgcgcggtttgggattgcgcggctcggtatcgcttggcttgggatcgaccgcctcggggtcggtcgccgacgtggcgtcagtctccggctcgacggcggcagcaggttttttcttgaaccagaacatgaggcatctccccaggcgtcaaggcttctcgccgatctgcatgatcagcgacaccgccttggagatcaccgcattggagatctgattcaacgcctgctggctgttgaccgcgttctgcagggacagccccgccgaatgactggccacctggtacagcgaggcaatggcctgggccggcgcctcggccaccaccttgacgttggtttgcgttacagcgtcggtaatctggctgttgacctctggcatacatctctccttgatggaaggcgccagcgcaggcgcgctggcggtgaactcgtcgacggtttcaggtgctcatgacacaagaacgcccggcatccacggctgtgaacgcaaaagcgctgtcaacgcagcgccgcccgcagcaactgcacgcgcttgcgcaccaggggctgggcgatgcccagctcggcggcgatctgtgggtatggcaactcctcgacaaaacgcatttcaaacaaccgccgctggagcaatggcagttgctccacgcgattgcccaactgcaccagtcgttcgaaccgctcggtgtactcgaacaccgataggcaaggcgcagcgagaagggcctgatgatcgtgctcaaggtcgatcgagtgatcgaacagctgcccttcacgcttgctgcgccgcaggctgtcgagaaacacgtggtccagcaccagaaacagaaaaccctgcggctctcgtatgcgttccggggaacgcctgaagaacagcagggctttcacggccgtgttggacagccactcctgggccagggccaggttgcccctggctcgccggttggcccggcgcatcagctcggggtacaccgctcgccagcttgcctcgaacaaccggtcgaccgccgccacttcacgaaaagatcccatcgccagcactccctgtgcattccttgatgagccgacagtctctgatcgcgcagcaggcgttcgctgttacctggggaacagctggacaattaattcagcgaacaggccttgcgccgcagatgctcgacatcgttgatcaccaggtggccgctctggcagctgatcacccccgaacgccgccacagctgcaactgcacattgagcttcggccggctggtgttgagcatcgaagccaggatgccctggttgcgcggcaccgccgcacaggtcgccggggccagctcgaagtcatcgatattggccagcaggaaccgcgccaaacgcgactccaggcgatgcaggcaaaccagttcgagcaactccaggatcttcatcaggcgggtcatcagcagcatcaggacccgctgccagaacagtggctcgtcgtacagcacccggaaatgccgccgccccaacagcagcacccgggtcgggccacaggcgaaggccgaggtttcccgggcgtggccctcgatcagcgccgactcgcccaccacctggccgacgccggcgctgccgacaatctgctcgcgcccgtccgggccatgaatcaccgaatacacctgcccttcggcgaccagcgcgatgaagtccagcgcctcgctcttgaggtagagcacctcccggtcactcaaggtgcgctccacggcatgggtggccacataacggatcaaagtgtctggcagccccctgaacagatcggagcgtgccagcagagtctgacgcaacgaaaaatcgagcattaccgcgccttttgaatgcatgcgttcgccttgactggtaggaaatcgctgcgcgagcacgcagcggtgagagcgcttgaagccatagagcaaagcaaacaaagggacgtccgagaggaggacttgtgaatgaggcgagggggcttgcgggtatcgcaaaggacaagataaacaacgaggcgacgaccaatcatcacgcgaaaaaaaaccgcatggacgccctaagccgacatgggtatgatgtcgcccgcactgcactcgtagctcagctggatagagtactgccctccgaaggcaggggtcgtgggttcgaatcccgccgagtgcgccagccagaaacgcaaaagccccaggtcgcatggcctggggctttttcgtttctggcatttgagtgggtcaaagaaccttgggcagtttgtcgatattggcgcgcctaaactaatcaacccctcgccgcgcaacctccaataagtccaccccttccctgagcagcaaataagccgcgtgggtcagccgataaagatcagcatcctcgatgcccttgatcgtcaccgaagtgaggctttccagaagatccgtcccagccttgatccgctgatgagcacaatccaacacatgcgctatcggctcatcactatcgatcagcagaacaggacagtcaggaaaattggtttgcagcggtatgtacttcgacatgacatgtcatccctaacttgattaagaagactgccgatctcgtcgccaaacgagtgggtggcagccgtacgcgggttggcgaaccggtaagttagtaaacccggcagacccgaaggtctcccgcgcacagccgccattgatcgccatcacccgtacagaaatgcacgcgcaaggagtcgatgacacgactgcgcctaactttaaacggatcgccaaatccggtcgctgatttttcagcgacagggagaactatagggagggaggtttgggaggaacaaggcggattggctgcattcgttgtgaggtatttcgcttcttgatgaagccttttctctccgaaaaccctttaggtgtctccaatcttttttgcgatgatgcctcccctgacgccattcacgcgcccagcccactgccgagcgcataccgtttcccgccagactcatggaagaccccacacgatgaatatcccgaacctttccggcaacaccgcgccgtcgcaccaggcgcgttattactacgggcccaactacaagaaaatgaccctggcgggcctggtcttcggtgggctttcgctgttcgcggtgttcggcacacccagcgagaacaacagcgtgatccggctgatagaggccctggggctcaatggtcatctggtcatgcaactgctcggcgtcctgggcgtggccatgaccgtcgccgccgcgggtgcactgatcttcctgcgtggcgccggcaatcgttatgtggtgctgacggacaagaagctggtggccccggtcagcaacttcagttcgaagatccgcgagattcgcctgatcaatatctcggacgtcgagctggtggaggtcttcaaccagcgcttcatccgcgtccagcacagcgacggcaagatggaactggtggagaacatgttcaagaaccaggaactgttctacgactgctacaaggcgattgccctggccatcgaggccaagggccagaacgtgaaacgcgcgcccgcccgcaagtaaccgcgccaggtttcagtctggcgtctgccgctgcggcgccgcttcatcctgatccgcggcaggttgggcctgttgcgggtcttcatcttcttcaccggcctcgagcagaaagtccttgcgactctccttgatggcctggcggatatccgcgcccttggtcgggcaattcagcagtgcagcgatacggtcgatgcgtggcgccatggccagcctctcactttcaggaaactggctcgatagtgcgcgttttcgtggtgccaggccattacttgcgcgcgttttgccctcagggttgctgcaaggcctccaggcgctcggcaatttcctcgtcggggaagcgctgcttcagggcgatgatgtactggtcggcgaccttgtcctggccggtctggcgcagccgcaatacctcgcgcagggcgtcgtcgaggatcgactccgacgcatggcgttcaaccggctccttgccctgctccttacccgggaatgacgccaggtgccccagggactcataaggcttggcggtgaaggcttcggtatcccgggtcagcggcaagcccgccccgggtgccgcgggagcgggtgccgacaaggcgccagcggccgcctccggcgtcgcggccagttcgaagcggttcgattcgtccatggttgattccgcatgggcggattccgcaggggcagcgccggcgggcgcagactcggcctggcgccgtgcaagctgcggggcagcggcctttgccacgggtgccggcgcgggagcgaatgcctggctcggtgccggctctggagagcgctgcaacacgcccagcagcagggtcacgccgaacaaaccggcgaacgccacttgccagcgcggctggcggcacagatcgaaccagcgttgccacagggaaggccggggcgccggggcttcgcggcgggccgtggccatgatcagggcgtcgaggctggccggcggctcgccgtggctgtgctggcgaatgtgctcgagcatgcgctcttcttcggtagggggaagctgtcgggcgtcagtcatgtcagtacctcctcggccaggagccgacgcagttttttcagcgcataacggaagcggcttttcaccgtttccagcggcgtatcggtaaggctggcgatctgcggcaactccagttcgccgtgggcgcgcagcaggaacacctcgcgctggtcggcgggcagatcctgcaaggcggcgtcgatgcgttgccgttcacggctcaggctcaggtgttgttccgggccgctggcgtcatcggccaggtcgtgcagctgctcgtcgtagctgtcgtgcagcgggttgcgcaggccgtgcttgcgccagtggtcgatcaggcggttgcgggcgatctggtacagccaggtacgaaaactggcccggccctgtggcgcgctggtggtgcggatcaggctgagccaggtgtcctgataaacctcgtcggccaactcggccttatcgcacaggctcagcaggaaccggtacaacccctggcgatgccgctggtagaggacctcgaaggcggcgctgtcacccgcgcgataacacgccagcagcgtttcgtcgctgctggcgggctctggtcgattcgccgcaggcatagtcgtgctgaactccttcgggtggctcgtcatggcgttattcacggcggctcaagacctccccggagcgtcccggttgatccgccggagcggcagtctgcaggctctgcgccagttccaccagttgcacgaactcgccacgcagaccgaagcggtcttcgcccttggcgccgcgggccagggcgacggtgtccttgaggctgaagtcgccggtgtaacgagcgtccttgagctgctgggcgaacgccgccacggctgcggcaaatcttagatcatcgctggcctggacgagtttgccgtgctgttgcgacgccaggatcggccgctcgatcagccggctgctgccgccttgcggcgcctggtagcgtacccgcagcatggccagctcgtcgtccttgatgttcgattccgacgacgcctgggcctggccataacgcagcggctccagccagccctgctcgcccttgggcacgatttcatacagcgcggtgaccgtatgcccggccccgatctcgccggcatcgaccttgtcgttgttgaagtcctcgcgtttcagcgcgcggttctcataacccagcaggcggtattcgctgacctgggccgggttgaattccacctgcagcttcacgtccttggccaccaccgccagggtcgagccgagctggtccaccaggaccttgcgcgcctcgcgcaggttgtcgatataggcatagttaccatcgccggcgtcggccagttgctccatcaggtgctcgttgtagttgtccacgccaaagccgagggtggtcagcgacacaccgcttttacgctgctcgacggccatctgcttgaggcggtcgaagtcgctgatgccgacgttgaagtcgccatcggtggccagcaggatgcggttgatgccgttcttgatgaagccttgccgggccatctgatacgccagctggatgcccgacgcaccggcagtggagccgcccgccgtcagttgctcgatggcattgcggatcttcgccttgtcgcgcccggaagtgggctccagcaccacccgcgattcaccggcatagaccaccagcgacacccggtcctgttcgcgcaactggtcgaccagcagcttgagggtgctttgcaccagcggcaggccctcgcggcgatccatggagccggacacgtccaccaggaacaccaggttggccggcgccagttcggcaacggtgcgatccgaggccttgatgccaatgcgcagcagacgggtgtgggggttccagggcgacggcgcgatctcggtggtcaagccaaagggcgaaccgtcgccgggcagggcataatcgtaggggaagtagttgaccagttcttccaggcgcaccgcgccttgcgccggcaggctgccctggttgagcagacgccggacgttggcgtaggcaccggtatcgacgtcgacgctgaaggtcgagaccggagcctgcgccacgctgtggatcgggttgtccggcaggttctggtactgctcccgcggttcggcgcgatagccggcgggtagcgattcgcgcgtcatcatcgaggcgtgcctgggcgccggggcgagcgccttggcgttgttgtatccagccaggatcacatcggcgcgcggggcctcgctcggcgagggcacggcggcctgcggctctaccgcctccggggcgggcaaggcagcgccccgggtgtccggcgaggacgggccgcaaccggccatggccaacagcaacccggcggcgcacccctgaacggcggggcgaaggtagtacggaggaaggaacatgggggctgacctcgggagaaattgatccattccccccttcagacgaagcccctcggcgattcgggttaagccccggaaaattttttcttagcgcaggtagcgccgcaccacgctgctgttgcgcagcacgtggccgttgatcttttccagcagctgggcgcgggtcaggccggccggcaaggcgtcgggcgccagctccagggcgtatatctggatgatgtagtggtgcgcgctgtcgcccaccggcgggcacgggccgacgtagccggtggtgcctttgctgttggtgccgcccagcccttccagggtgcccttggcccccgcgcctgcggcgatctgccgggtcgtgggcttgatcccgtaatgcacccagtggtcgataccctggcctttggcgccgtccgggtcgtgcatcacgatggcgtagctgcgagtaccttccgggccggcggtccaggccagggccggcgacaggttatgcccgccgcagcccttggcatcgctggcgctggccggggtgaacaggcggttgtccgagacaccgggcacgttcagggtgaaacgctcctgggcctgggccggcaactgcaggcacagcaggacggcgccggcggccagccaggtattgagagaggcaaaacgggacatacgcgagcaccttctgcgaatgggttcatcggagcctggaaacaggagcctggagactatagctgcgcggcgcagcgttgcgcttgagcaatattggcgctgattgagcttgagccgcagccgcttgtaaacgaaaaaaccccggtttttttcagctccggggcttttttcgacgagcgccgggatttttacccggccgccctgatcccgcgaccttcaaccagcagccgaatcagcgctccacggaatccgccagcaacggcggatgcggctggcgctcggggttcaggcgcaagaaaccggtggtgacaaggctgataccgccctcctcgtcgttatgcaccgtcatggtcccgggctggcgcatgcgcgcaaaattggcggcgctgagcttgaagctttcgctcaggcgctggtcgtccagcgccggcgacggcaggcggcgccgggcaaaacttttgctcttgcgctgctggtaacgcgcccagaggatcagcacggcggcgttgagcagggccacccacaggtaggtctgcaaggtgcccagcgcttccagcacgccgacctcgatacgcgggccgtcgtgggtgtcgatcagcggccacaggccgcgtaccagcaggtacagcaggccgatccaggccagcacggtgaacgccgcatcgacgatcaccagcaatgggcgttgacgggttctgatgattttcatcagcgagcctcctcttcatcatctatcggcttgatgccacggtcggggctgacccagcgcgcacgcttctggtgttggctgaacagcaccttggggaaactgacaagcgtggtgaacaggctgacgagccagaacaccagggggtaccagaccacccagaacatggtcttgcccaaacccttttcataccggcgatcgatcaggatgctgaccgcgaactgcagcaggcagaccatcgccagcaccagcccggtgaaggccggcggcatcagacggtcgacggcgatggcctcgggcatgacgatgaaatggccgacgccccagaagatcaccgacagcaggaaggtgaaggcccagccggtggacaggcagtattcgaacagcagcggccacaggtagcggtggcgccattgccagatcccgcggatgttcttgaacagcacctcggcgccaccctgggcccagcgcaggcgctgcttccacagaccgcgcagggtttccggcatgaggatccagcacagcgcccgtggctcgtagaagatgctccagtgatcgagctgcagcttccagctgatgtcgatgtcttcggtgatcatgtccgggctccagtagccgacccggtgcagggccgagcggcggaaggcgacaatcaccccggagaccgtgaagatccgtccgaacacgcgctgggtgcgcttgatcaggccgatgatcgaagagaactcgcccacctggacccggcccaccagggttgagcgggtgcgaatccgcgggttgccggtcaccgcgcccaggcgcgaattctccagcagcggcgccaccagataggccgcggtgttcggcgccagcagcgcgtcgccgtcgatgcacaccagatattcgctgcgcgccgccacggcgcccatgcgcagggccacggccttgccctggttttgtgccaggtgcaccactcgcagccgcggatcttccagcgccagggcgtccagcacttgcgcggtgttgtccttggagccgtcgttgatcgcgatgacttcgatgttcgggtagtgctgggccagcgccgcgtggatggtgtccgccgcgttgtcgccctcgttgtagcaagggatcaggatgctgatcagcggctcgcccttcagcggcggcggcaaggtgtcgtccttccagggccagtggcgttcccagtgcagccagaagtacaggccaccggcaatccacaggccggacatgaacagcgggtagaagaacacgaagtccatcaggaactggccggtcaccagaaagatcaggcccagcggcacaccgaggacaatcgccaggacgagcagagctagcagtcgatccaacatgatttaaggattccacttggtggagagcgcgggacggatggtcttcaggtccggcgagttctcgagaaagttatccgggtagtagccgaaactggtcgcgccctggcgcttgagccggcccatccagtcagccatctgcgcggcgtcgatatcactcgccggtttttgcgcccagtcccgggcctgcagttcgaagacggtacggttgagcgcgccgggacgtgccttgaccgtggccaccagttgctccagccaggcgccggaagccttgcgctgctggccctccatcaacggcatggccatcggcgcggtccagtcgtaatgggcgaggaagtcgtcgaggttctgggcgtaccaggcttcgctctgcgggttgagcatcggctcggcgaacaggttgcgcgcggtcagtacctgcggcccacggatcgccttgaccttggcggtcagctcatgggtgaagtcgatcaggtagcggctcttgaagcgggtccagcgctgcagggtcgccggatcggcgcgcaaggcggcgatcgaaccgggcaggccgttggcggcgtaggtgcgcagggctgcggggctggcgtcttcgaaatcggagagcaccgcgtcgtcgtggtagaggatgccgtccaccgaggtcaggcgcgccacgtcttcgtagatctcaccgatgatgcgtcgcacccgcgggtcgaacggcgacaggcgccggtactggtcggggtcgggcgcgacctggccggtttccgggtcccagcgggtcacgcgcggcaggctcgggtcgagggcgaaactcagcaccggcatccaggcgaacaccttgacgttggcccgggtgcgcagttgccaggcgacccggtcgaagatatcggcgcgcaccggcaggtggcggttggcgaagtacagcgagtgcaccaggccatcgcccttggggtcggcgaaggcttgcagaaacacggtgttgacgcccaggtcggccatgcgctggaccagcttgccgaggttgatttcctgctgctgcgggtccgggtcgtagacgttgtccaggtcgacatgggccacgcgcatcgggttgctggcctcgacgccgacgacgctgttggagaagtggatggcgtccgggtccgaggacaccaggaagcgcgggctgctcatcaggttgtcgagggcatcgaggccgtcgtctagggtcagggccatgtcgtagccctgctcgcccaccacccgcagcgcggtgccgtcggcggcgccataaggccagacccagacccgtgggctgtagccggtggcggcgcggatttttttcgagatggcggccacgtcgctgcgcaggcgcgcctcgaattcggcttcgctttcatagcgcccggtgctggcgtcatagcgccgggcggcggcggccggttgcaggttgccctgggggttggccagcacgcccttgtggttggcatcggtgtgggcggcgatttccaccaggccggaacgggagatctcgcggacctgctgccaggtcaggaagtccgagcgcttgcgcggggtgccggcaaaatccaccggctggttcagcggggtatcgacccacgcccccaccggcgccagcagggcatgccagttgtagctgcgcagcaccggcagcacgcgggtgtagaaactcgcataaccgtcgtcgaagctcagcagcacggccttggccggcagctcggggccgcctttgcgcgccgccatgatctggtccacggtgaccggctggtagccgttctcgcgcagccaggccagctgttcgatcaggcgttcggtgcgcacggccaccaccgcctgatcggggtcgcggtcttcaacgtcgtggtaggcaatgcccagcacgtggtttttcggccacggggtttcgctggcgggcaccgggcgttgcgccggcgccaggaaatccgcggcgggctgggcgcaggcgctgagaatcagggctcccagcaggaggatgcaacgggtcatcggaggcatcttcggactcttctagaagcggtaggtaaggtcgaggagcaggcgcaggtcggtttcccggtcgccgtcgtaaggccggttgagcacgctcagggcggcgccggcttcgaacacgtcgttccaggtcacgcgctggccatagctgagcaggccgatcgccccggtggagtaatcgcgctggctgtaggtaccggcgcccacctggaactgctggctccaggaggtttcgtagcggtgatagagcacgtggttgacgttcaccgtcggcaggaccgtgaagtccgacttggggttgaagtagggcgtgtcttccttgctgttgcggctggcgccgacttccaggcccaggtcgacctgcacgtgaggcgtggcatagacgccctcgcgaccggtgagcagcgcttcgaaacggttgttgccatcgctgaaatgcgaggggctcagggccagtcgccattcccggctctcgttggcccgccagcgcacgaagccgctgccgccattggcgtagatgttgctgttgagcgcccgcagcggcgtgttggccgacaggtattccaggctggcgccgtactgccagtgatcgtcgatgtcgtgggccagggacagccgcgcgccctgcttgtcgtcgaagccgtaggagtggttggagacttccgcttccagggtcatgtcgcgggtccggcgctccacgccgatacgctgccagcggtgatgcccggtgccttcctggaagtcgccggtggcatagccgaggccgccgaacaggcgccagtcttcattgatcggcgggctgtagagcaccgtctcgatgccgaaatccttgctcccggaaaccgcgccggcgccgctgttgccgccgccgtagctcttgccgccataggtctcgacccgcagctcggccatgtcgtgcacttcgcgctggcgagccaggcgctgcacctgacggttgtcgggataacgctgcaccacgtcgtcggtcagggcatcgagctgacgccattcctgcaggtcctgggcggtgtggccctgggcgacctcgaggccgacatcgcgcggcgccatgctctcggtttccttgagcaggccctcggcgcgccgcggccagtcccgggcctggtacaggttggcctgggccacgcgcaggccgatattgcccggggcctggtccaccaggctggccaggcgctgctcgctgcccggcaggtcggcgctgtaggtgccggactgcgcggcgagctgctgggcgtccatccattcatcgttggggttgcccaccggcaggcccttgagctcgacccgcggcttctggttcctggccaggtcgtcggcgacctgttgcgcttcctgcgggcggtcgctttccagcaaggcgtaatacagcgcggtgctgtcttcgacgcggtcgctgacatcggcatccggcgccgccagcacctggcgatagaggtcgctggcgatctccggctggcgctggtccaggtaggcggccgccacccagcgccgggcgtaggtggggatggccacgtcttcggcggtcagcttgtggtactcgtcgattacctgggcggtgcgcgcccgggccttgagcgcgcccatgcggtcgatgcgccagcgggtcacgtcgtccctggccgccgggtccggggtccaggtggcgagcaactgatcgtaatcggccagggcacggtcggcgatgacatagcgctctttctcgctgcgggtcgccagttcggccaggcgcacgcgctcggcggccaggtcgccttgcaggcgacgctcgattaccggatcgatcagccccgggcgctggcgcgccagacgcaaggccggttccggcaggcgggcccgttgcagggcgaacacgtattcgcgggcgacttccggccgggtgccggcgcggacgaacgcctggtcgaactcgaacagcgcgtcatacggcgaaccggcgcgagtcagggcgtagcccagggccaggcggcgggtggcgtcgtcgggcttggccgccaccagctcgcgggcacggcgcacggcttcctcgggcttgccagcgtcggcctgggtcagggccaggcccagttgcaggtcggtattgcgcggatcgcgttcgagggccaggcggtacacctggatcgccgcgtcccagcgctgcagattgcggtaggcccgggcggtggcagtcagcgcctggatcggcagcacccggccacgggcctgggtttcatagacattcacgacttcagcgtcgaggccggcccagctggcgatctgcaggtggtcgctgaccagcccggtgctcagccgttcggccggcacctggcgcaaatggctcagggctggcgcatagctgccagcgcgggcgtcgagaatcaggcggtcgtacgctgggtcggcgagggccagggtcggccacagcaattggctgcataacgtcaggcgcagcagcggtcgcaaaccataaaggcgaacaggatgaacaatgaacggcatttcttcagcatccttacatggctagccggggtcttgtgtccccccgcctgatacgtgccaggaagccgaatcagatgactcggccagattgggacggagtcttccacgcaaggctgatgcggatgtgcaaatgcaatatttcttcagattcgtttctgcgcgaatccgcgaacgacgtggcctgtagccatgttcgaggaggctctgggcggggattctccagccggatgcaggtaaaaaaacgcccggcagctccgtggaacggaggccgggcgtttctggctgaaaaccccgtggaggggttttcgaggcttactggatggtgaccgggcccagtttgctcatgacaaaaccgacgaactgctcaggcgtcattttctggccgttgaagtccacttcgttgttggcataacgcaacttggagacgatgtcgttgccttccagcttggccagctgggtgcccagcgccatgccgctgaccatgtcggcggccatgctgccctggtcggcgatcgccttggcgtcggtcaccccgtccagttgcgcctgcaccgatgccacgtcggcgatcatcggcttggacagcagcaggtttaggtccagctgggtgagcagttgcttgctcagttcggccggcggcagctccatggattgcggcttgttcaggtccaccaccaggctcaggcggctttcgccattggtggtcttgaacgagaggttttccagggcgatgtgcggctgggcagccagcagcttgtccaggtcagccttgacctgggcctgctcggcctcgctcaggttcagctcgggcgctggctcgccggcggcttcggccgcggcgacggcgtcttcgtagggttgcagcttgttctggtagacctgcatcagcgacatgccggaggcgatgtcgaggttcttcatgctccaggtcatttgcgccgaaccgacggctttgccgttgagggcgacttcgccgatcttgtagtcggcacggccggccaggtgggcgccggtctcgtcggtggcgctcttgatctccgagttcttgaagctgagcaccgactgtttctcgccgaacgtggccttggtgctggtcagctccagggtgttttcgccgacgtagaagccatagttgctcttggtcaggttgctggccagggtcaggccgttgagctcgacctgcaccggcgtctggtcttcggcgacgctgttgagcttgaggctgtccatgtagccttcggccttgaccttctgcgcttcggcgctggtcgagaggtccagcttcaggccggagaacttgagggtcgacttgtcgtccagggccgtgtccagcggcagcaactccaggttgccggtggcggagcggtcgtaccccaggttgaccacgcccttgagcggggaaacatccttggtggcggcgaaccatttctcggtcagggcgttcttttccagctcgtagtgactggtggccatgaccggcagccatttcagggtcatcaggcgcgagaacggcagcgggccatgttcgatgcggtcgacgaacaccagttcgacgccctcggcgctgtcgccgaacatctcgccctggcccttgaggcggtagcgcgcggtgctgctgaacaggttgcgctccagcgataccagctccaggctggcggtaccgttggaaccgaccatcgcggcctggagttccttgttggcgtcggcgatagaggtttgcagcaccccttccagcttggtcccggtataccaggcgccgccggcactgatagcgcccaccgcgacgacgattcctaacagtacgcctgctgatttattcattatttgacccgatcgatccgttgttgaaatgtgtggtcgtcttccctgaacccggcacgggttgtggctcgactgtgcgtaaaactgccgaagattagcaccggccaggccaggcggcccaacctttccatgtgaaaagtcgtgaatgcgcagggcagaaagctatagcgcgtttagccaggtaaatcgcggagtcaggatttgcggttgctgcgcaaccgttcgcagcctcgcgggctcggcagcggctacgtaggcgccgcgttcctgtagccgctggcgcagcctgcgatcgacggcgtagccgtcgctgggccagacggcgcgtttcttcaggcagatcgtggactcagggtttgcggttgctgcgcaaccggtcgcagcctcgcgggctcggcagcggctacgtaggagccgcgttcctgtagccgctggcgcagcctgcgatcggcggcgtagccgtcgctgggccagacggtgcgtttcttcaggcagatcgtggactcagggtttgcggttgctacgcaaccgatcgcagcctcgcgggctcggcagcggctacgtaggcgccgcgttcctgtagccgctggcgcagcctgcgatcggcggcgtagccgtcgctgggccagacggcgcgtttcttcaggcagatcgtggactcagggtttacggttgctgcgtcggagtgccgcccaaaccgttcgcagcctcgcgggctcggcagcggctacgtaggcgccgcgttcctgtagccgctggcgcagcctgcgatcggcggcgcagccgtcgctgggccagacggtgcgtttcttcaagcagatcgtggactcaggggtttacggttgctgcgcaaccggtcgcagcctcgcgggctcggcagcggctacgtaggcgccgcgttcctgtagccgctggcgcagcctgcgatcggcggcgcagccgtcgctgggccagacggcgcgtttcttcaggcagatcgtggactcaggggtttacggttgctgcgcaaccgttcgcagcctcgcgggctcggcagcggctacatggctacgtggcgtgttcggagtattcgacctccagcgcgtcgagctggtgatcgaagcttttcaggcgggcggtccaagtgtagaccagcacttcgaaatcgcgattgatcaccgcaccgcccggggtttccgaacgcgggtcgcagaaatccagttgatagcgttcgcgggccatggcggcggcgacatcggacagttcgcgggcgttgttcagccagtggcgaccgtcggcggcctgtttatccagtaatacgcactgttttttcagggcttcgaggcttttttccaggggggtgccggtcaactcgcccatgacttcctggaaggtccgccccggctgccagtaactgccccagaagtaacggtcgaacaccgtctcgacccggcgcagggcgactttggtgtcccagatcgcgaccagggtcttgccctgctccaactgcctttttttgattttctgggtctggaacgacgtccaggccacgaagacgatggcgctcaccgcaatcagcgcgctggcgctgtcgagaaagatcatggccttgtcgatctggtgcgccagcatgacaccgtagaaataagtcgcagaaagcagcaccagtgcgacgatggcgcaccagaagccgagagcataagggtttttcattattggaatccccatgaccatcacgtgcctgaccgctggccaagcactggacgcaaggtgctcagccaactgttcaaagcatagcaacggcctcagggtttggcggggttcgaggcttgcgttcgtccgctttcccagccaccgcccagggccaggaacaggtcgatctgactcatcgccacctgggtgttggccgcggccagttgggcccgtacgtcggtataggtgcgggtcgcctgcaggtcggcgaggaacgactcgcggccggcctggaagaagcgatgggtctggtcggcggcctggcgcgccgactgctcggcctcggccagggcgtcgcgacgctgcaactgggcactgtattgggccaggccggtctgggtttcgcggatggcgttgagcaccaccccgtcgaaatgcgccagggcgccctggctggcggcttcggcctggtgaatgcgttcgcgggcgccgttggccgggaccgtccagctgatcagcgggccgaagccccagcggttggtggaggttttgccgaggttgtcgacaatgcccacggtgccaacggtcgcaccgatgctgatgtccgggtacagcgcgccagtggcgacgccgatatcggcggtggccgcggccaggcgacgttcggcctggcgcacgtcggggcggcgcttgagcagggtcgcgccgtcacccaccggcaacaattgcgcaatatgcggcagctcggcacagctgtcggtgccggccggcaactggttcagcggcttggccagaagcatcgacaagcggaacaggccggcctggcgcgccgcttcatagcgcggcagttcggcgcgcagggacttgaactgggtctgggaacgggtgacctgggtttcgtcgccacgcccggcgtcgcgcaggcgctggaccagcgcggtgctctgggcctgcaggtccagggagtgctcggcgatctcgcgctcttcattggccgcgcaaacctgggtgtaagcccgcactacgtcggccaccagggtgatgcgcgcggtgtcggccgcggcctgggtggcatcggcgttggcctgggcggcctcgatgccgcgctgcagggtgccgaacaaatcgaactgataagaggtgctgacggacaggttaccgacgttggccaccggtactttctccggcagcaggaaggcttcgccggactcctgcaggcgctcgaccccggccttgaccccgccgctccagccgccggccgcctgggcctcgtcgacctgggcgcgggcccgcgccaggttggccgccgcgacccgcaggtcggtgttggaggccatggcctgctgcaccagctggtccaggcgcgggtcctggtacaagcgccaccagtccgccgggaccggcgccgagaccaccttgtcgctcgatccggccagctcgccctgtaaatcgctgcggtgcagcgccgcgtcgtccggcaggtggtagtccgggccgaccatctggcaggccgatagcagcaggcccaggccggcggtggctaaacgcaggccgctgttcattgccccggctccgaccggctttgcgcctgatcgtcgatgatcgacacggtggcggtgcgcccggcgatcatgcggaagtcttccggcacctcgtcgaaggcaatccgcaccggaatccgctgggccaggcgcacccagctgaaggccgggttgacgttgggcagcaggttggtgccgctgctgcggtcgcggtcctcgatgccggcgacgatgctttcgacatgcccgcgcagccgcgcgcgatcgccgaccacgcggatatcgacgctctggccgatgtgaatgccgtcgagcttggtttcctcgaaataaccgtcgatgtggaaggagttgctgtccaccaccgacaacaccggacgcccggcggtgacgaattcctgggtccgtggtgcgcggtcgttgacgtagccgtccaccgggctgcggatcaccgaacggtcgaggttcagctgggcgctgtccaccgccacctgggcctcggccagggccgactgggcacgggccacacgggactggctttcttccagttgctcgcgcggcaccaggttgcccaggccgaggttgcgcctggcctcgcgctgggcctgggccagggtttcctggcggtcggccagggacgccttggcctggcgcagggccaggctgaaacggtcctggtcgatgctgaacagcacctggccgcgcttgaccagctggttgtcacgcacctgcacctgctggatcagcccggagacgtccggggcgatctgcacgatgtcggcacggatatgcccgtcccgggtccagggcgcgaacatgtagtacatcaccatgcgccagaccaccacgaccgcgaagctcaccaccagcaaggtcaggaccacacggccaatggtcaataaaggttttttcatgtcatcaggtatcgactgagtgagtccacggcgccgagcagcaaagcgtacagaccaacgttgaacaaagcccggtgccagaccaggcgataaaaatgcaggcgcgtcagcagcccgtggaccaccaggtacaagccataggtaaggcccatcagcaccagcagcgtgggcaggaacaccccgctgatatccaggtcaccgatcataaaggcgctccatcgatgccatggggcagcggttcctcaagctcgccaccgccgacgaactccacaccgggcagcagggccaggcgcaggccgctgagggcatgcagcaggtgcaaacgggtttcgcggtcgtcctggctgtgggcatccagggtgcgacgggcgcggtccagggtcatcagcaggccgctcggcgccggcaggcgttcgccggccttgaggcaagccttgaagtaggcgccgacctcggccaccacctggcgcaacagcacctgcgcgttgccctgggcccgcggcgcataggccagcaggtccagcaggttcaggccgacgcgcacttcgcgcagggcgccgccggtgtcctggccggtcatggccaggcgcggcaggtgctgcatcaggcggtcgagcatctgcacccccagatgccggtgttcggccaggttggcgggctcggtcatgccgacgatgtcctgccagctgaagcgggtcatgcgcttggccgccagttccgagccgaacggccgggcgaccagggtccagacaaaggcgaacagcaggcccatgggcccggccaggttggagttggcgaagctcaggaagtcggcgtcgtaggcgccctggatgctgatgaaggacgaggtgttgacgatggtcagcagcatgcccaggtaaaaacgcggctgcaccgtgagggtgccgacgcagatgaacggcacggcgaaggccagcaccagcatcgggaaatcgtgcaggttgggcaggatcaggaacaggtagaggctggcgaacagcaccgacatcgcggtccagaagaagaaccggtagatctgcggcgccgggtcgtccatcgaggcgaagaagctgcaggccaccgccgcgaggatcaccgcgctgccgccgtcggtccagcccaggagaatccacagcaccgaggcgacgatgatcgccaggacagtggaggctaccgaatacagcatcagcccgcggtcgaggaatggcgtcaggcggcccaggcgccagtggcgatagaccgcgcgccagatgtcctggctttcgcactggatggcgtgttgcaggctgcggcagtcctgccataggtcgatccactcgccaaggcggtacagggcgttggaaaacagcagctggcgccggtcgtcgagggcttcggcgtccggttgcagcgcttcgagctcactgcgcagggcctgccagcgctcgaccgaggcaccctgggcggtgctttccagccattgcccggcctgggccagcagcggcgcgaaccgctccaccagctccggggtgcgtcgctccagggcgtacagcgcatcgtccagggcgtccaccacgggtagcaggtggatcatgcgcccgcgcaattccttggtattgcgcacggtctgcgggcgcgcgccctcatggggcaactggccgatcatcagctccaggctgttgaaggtggcgaccatggacgcgcgcagggcgctgacttcttcgggctgcacgttgcggctgagaaagcgctggctgtaggtggaggcatcggcgaaccatttgcccgccgaatcgacgaacaccggcgccagccgccgtggccagaacatactgccgatcacggccgcgcagacgatgccgaggaagatctcctcggtgcgggcctccgccacgtcccacacccccagcgggttatccaccaccggcagggcgatcagcggcaggctgtagccggccagcatcagcgcatagctgttggcggtgcgcaggtgcagggagaggaacagcaggatcccggtccacagggcgatgatcaccaccagcagataggggctttgcacgaacatcggcacgaacagcaccgccgccgaggcgccgagcaaggtgccgatcgcacggtacagcgccttggaactggtgggcccgacgaacgggctggagacgatgtacaccgtggccatcgcccagtacggacgcggcatctgcatgagcatggcgatgtacagcgcgatcatcgacgcggcaaaggtgcgcacaccgtagaaccagtcgcgcgccggcggcacgccggtaaagaatccgctcaagaaggcaccgccggcggctggacagccgactcgaaggcgcggatcaccttcagcgccgtctcaaggtcggctggtgtgatgccttccagcacctcgcgacgcaggcgcaccagctcggcttccaccgactgcaccagctcgcggccggtggcggtcaggctcaggcatttggcccggcgatcgtgggggtcctcggtacggcaggcgtagccggcgctgcacagctggtccagcaggcgcaccagggacgggctttccatccccgccgcctgcgccaccgtcacctggcgcacgccctcgcccaggcgcccgatcatcagcaggggcacggcgcaggcttcggagattccatagttgaccagcgtgctctgacagatccgccgccaatgtcgggcggcgaccaccatgccactgctgatattcatctggagtgattcgagagagtcgggcaaaagaaggttcgcacactgttagtttgctaactatcaatggtgcatggggggataatctcagtcaagttttgaaacaattgaatgaccattaaccggaaaatacctcagcgctttcgtgcccgctcatacacggcgctgcgttcacgtttgcccacggccaccaccgaaaccaccacctgatcctcgatcacttggtaaaccaggcgatagccagaggccttgagcttgatcttgtagcagtccgccatgccgtgaagggcatccgcgggcacccgtggcatttccaggcgctcggccagcttcttcttgaattgctcgcgcagggtatgaccgagcttgtcccattccttgcgcgccgaaggcagaaactggagcttataagtcatccagatttaccgggaccggggtctcgtgccgacgggcacggacaatctccgccagttcaagatcgtcaagacgctccatcatggcttcaaacacgtcggccgggaccatatagcccatgacccggttgtgattgagcaccgcaaccggaccaccgtgtgcgccgctcaggacagccgaggggttttttttcagttcagacacgctgacagctttatcagccaatacgctttgcatgattaagacctctaatttggtcttaattctggtctatttccatggcaacatcaattcgcgcctcaaacaccccgccccttcctcaacaacacatccagctgatccaccacttccgcccagtcggcgtcgtcgaggatctcgttgcgcaggaaatccgcctggctgctggtccagaagaaggcatccgccaggtgcagttccggcttgagcggcgaatgggtggcgatgaaacggtcgatgccctcggggtcgtcgggcaggccgagttgtttgaacagggcgggcaggctgtgggatggggattccatgggggctcctgaatgggttgggtgttggttgaaccactgctgcgcagtcgatcgcgaacaagctcgcttctacagaaaacaagcatttttgtaggagcgagcttgctcgcgaaaggtggttacatacgccaacggcgctagtaactgacctcgcacacctcggcatgaggcaccattttcaggtactcgtccatgctcagatgcaccaggttgttgtggttgccggcttccaggtagatgtctttctgccgggtcagcagcggatcgatcaccacgtccagcccataggattcgcccagggccggtaccgcgccgcgttcacaatcgttgaacagatgcgccagggtgctttcccgggtgatctgccattcgttgctgccgcgcaccttgctcaggtccaggtggcgactggccggcagcacggccatcaggtagtggccgtgactgtcgtcgaggatcaccgacttggccacgcgctcggcgggaactcccgccacccgggcggtctccaggctgctcgacgaatgtggatgagccaccacgtcaaaatcgcaatgcgcctgttccaggctgcgttgcacggttcttgccatacgcatgatgcacctcggtgtcctgaacggctttgcaggactatgggttaacgactgtcactcccttcacaaagtctaggccgcgccgccctcgcccactgacgaacttccgaacggcacacgagcaagaggctgctcaaaatttgctcaatcccacgctctactagactcaaggacaaagccagcgaacggctggcaaccgaggcacatgactctccaggagggtcgaatgaacgagcgtgggtggcgggcgacactgaaggggctgctgctggctgtgctgatcggcctgccgaccgggcacgcccaggccgtgaagccagtggtggtgctcaccgtcaacgatgtgatcagccccgccagcgccgactacgtggtgcgcggcctggacaaggccgccgacgagcacgcccaactggtggtgctgggcatcgacaccccgggcggcctcgacacctcgatgcgctcgatcatcaaggcgatcctcgccagcccggtgccggtggccagtttcgtcgcccccagcggcgcccgcgccgccagcgccggcacctacatcctgtatgccagccacatcgccgccatggccccgggcaccaacctcggggccgccaccccggtgcgggtcggcatgccggggcagcccgacccgggcggcaacccgcccgccgcgccacgctcggacaagaacccggagccggacaccgacaccctcagccacaaacagatcaacgacgccgcggcctacatccgtggcttggcgcaattgcgcggacgcaacgccgaatgggcggaacaggccgtgcgcgaggccgtcagcctaccggcccaggaagccttgaagctgaaggtggtcgactatgtcgccgatgacctgagcggcctgctcaggcaactcgacggcaagttcctcatcgccgccggccaggcggtgcagctgcataccctgggggcggcggtgatccatcacgacccggactggcgcacccagctgctgtcggtcatcacccaccccagcgtggcgctgatcctgatgatgatcggcatctacgggctgttcttcgagttcgtcaacccgggcaccgcggtgcccggcgtgctcggcggcatctgcctgctgctcggtttgtacgccttgcaactgctgccggtgaactacgccggcgtggccctgatcctgctgggcatcgccttcatggtcgccgaagcctttctaccgaccttcggcgtcatcggtttcggcggcatcgtctcctttgtcgtcggcgcggtgatcctgatggacaccgatgtcccgggctatggcattcccctgccgctcatcgtcggcctggcggtggtcagcgcgctgctcctggcgacgctggcgagcatggcgctgcgcgcgcgacagcgccagcaggtggccggcgacgcggggctggtgggcagtgtcacggcgatcaccgcggtgcaaacgggcaacccttacaacggctgggtgctgttgcagggcgaacactggcaggtcctgagcgcaacgccgctgcaaaccggacaactggtacgggtggtggcccgcaaagggctgcttctggaagtgacgacggccgaggccgcgccgcgaggaggatgaaatgggtctggaattgggttttggcgcgctgctggcgctgctgttggcgctggcggtctcgacgtttcgcatcctgcgcgaatacgagcgcggggtggtattccagctcgggcgcttctggagggtcaaggggccggggctggtcctgctgattccggtcgtccagcagatggtccgcgtcgacctgcgcaccgtggtgctcgacgtgccgccgcaggatgtgatcacccgcgacaacgtctcggtcaaggtcaacgccgtgctgtatttccgcgtgctggactcgcagaaggcgatcatccaggtcgaggatttcctcatggccaccagccaactggcccagaccaccctgcgcgcagtgctgggcaagcacgagctggacgaactgctggccgagcgcgaacgcctgaacgccgatatccagcaggtgctggacgcccagaccgacgcctggggaatcaaggtggcgaacgtcgagatcaagcatgtcgacctcaacgaatcgatgatccgcgccatcgccaaacaggccgaagccgagcgcgaacgccgggccaaggtgatccacgccgaaggcgaattgcaggcctcggaaaaactcatgcaggccgccgaaatgctcggccgccagcccggcgccatgcagctgcgctacatgcagaccctgggcgcgattgccggcgacaagagctcgaccattgtctttccgctgcccatcgaattcctcaagggcatggcggacttgtcgccgaagagctgagacgcgtttgcggtactgcgctggccgccctgctgcgccactgttccagcgccgcgtaaggcgcctgcgcccattgctccagctgctcccgcagccgggctgaagcctgttgctgcttgccctggcgatcatcgacaaaggcctgcgccggctgcttggcatgctggccgatacgggcgaaggccgcccggcgttgctcggtgcccaggccgaaaaaatcgcccaggtggccgtccatggcgacgggcagttcgctgtagttcagcgccaggccatgatgttcgcggcagtgttccaaccccagctgcaacaaacgccccagacgccgggcgacccagctttcccggtcctggaaaggctcgccgtcgtccagcgcgcacggtccgatcaggcccgacgtcatgtgcatgccggcccggcgcagatgcgacacggcgatttccagcgggtcgcgatacacaaacagccacggcgtatcggcaaagcactggcgcagcagcggcagctcaccgatgttccaggcatcgagcttgatcaccaaccgctgctcagtaccacggcgtacctgcccataggccgacaccaggcccacaagcgcggcagcccgctcctgtggcgccagcgaaccacgcagcagggcatccagcggcggcggttcggacaccacgatatgctcgtccaggcaggccagcatctggctgagcagggtcgagccgcagcgcgaggcatgaaagataaaggcgctgggagccaggcccgggctgcgttggcgccattcggtcagggcagacaaaggcgtctggcggcggaacgcctgattgaacggcaggcgcagggcctcttcgaccgcctcgcggaaaaacggctgcgacagcggccggtcgccgaaccagcaccagtcgacccgccactcatcacccggctgccaggcgcggatcggcaaccagccgcggaggttcaggccgtccattgttcattccacagacgccgcccctggcgcatggccgaacgcaggtcttcgcgggtgaacgccaggccacgctcggccgccagggccagggtgcgctcgataaaggcttcgctgtcggtcggcgcctgcaaggcctggcacagcgcggtgtcctcttcaagcagtcggcaaaaccgcgcgaagtccagggccgcgcggcccaggccaggtgccggggtggtcggcgctccggcggcaatcgcctgttccagccaagggtcggggcgacagtcgagtaccagatgaatacgtgcctgagtgtcgtagttatcgacccgatgcgcgcgcgacaggtcgagaaaccagcactctcccgccagcatcggcatgcgctgcccgtcgagcaggaaatccacccgcggcgggctgagcagggggatatgcaggcgcaggtcggcgtccgggccgcccaggtcgtagtcgcggtgttcatggatgcgcgcccccggccccaaccgcagcaggcgcgccgagacgatccgcaagggcagctgccgcaatgcctgttgccagtccgggtcctgccgccagggctcgcgctgcaccggcaggcccttgcccggcgccagctcggagggcgcgtcaagcgccgagatcaaggccacgccgctccagtcgccctcgtaataatcgccgttgaagtggccctgccaggcgctcgcgtcgattcgcgccagggcgcgcaacagccgcggcaggtccacgctgacgggcaggcgggcgaacgccggacggctcatgaggccggcagcacctggcgctcgaccagccagccgagcaattgccccaggcagtcctcgaccgactgagcgccggtatccagttccagcgccgcccgtggcggctcgtagggcgccgagataccggtgaaccccggcaactcgccgctgcgggcgcgggcgtaatggcccttggggtcgcgctgctcgcagaccgccagcgaggcgctgcaccagacttccaggtagtcctcgcccaggcgccgggcgaacagctcgcgctgctcgatcagcggggcgatcatcgccaggatcacgatctgcccgttgtccaccagcaaggctgccagctcgctggcgcggcggatattttcccggcggtcggcctcggcgaaccccaggtcgcggttcaggccgccgcgcaaggcatcgccgtccagcaccaggctctgccgaccgtgctggaacagcccggcctgcagcgcctgggccagggtcgacttgcccgccgccggcaggccggtcagcaggatcgccacaccgcgatggccgttgcgcgcctcgcgctgagcgcggctgacgctggcctggggggcctgcaggttattgtctttgggcatgggccaccggcgtgctgatgttgcccgccgcccagtcggcctcgcggctggccagcgccgtggcgatggactgcacctgggtcgactgcacctcgtcgggcagcgggtcgaggccggcgctggcgaagatctgcccgtaggcgttgcgcaggtcggcataggccaggtcgcgccgcaggtccgcctgcaaggtgttcagctcgccctggatcaggtccagttcgccgatgctgttggcctggtagcggttgcgcagctggccgacgatctgcccgtcgatgtccgccagctcctggctggtcttgaactggcgcaaggcgtcgcggtagttggcgttggccacgtagacctgggccagcacggcaatcgacatggcctggcggcgcgccgcggcgacgtcttcaccggccttggcagtgtcgatggccgccggcgcggagagcacattgaacaggttccaggtgaccttcaccccgtagtcggcccacttgtcgttgaccaggaacgagttgctgtcgtaatgcccgccggcggagaactccaggcccggcagcaggcgcagcatggccttgcgggtctccgcggcactgatgcggctctggtaatcctgctcgcgcagttccgggcggctggtcagcgcctcgtgctcgaggcgggccatatcgaccttgagctccggcaccgggtaatcgtcgctggtcgccagggtcaggtgggtggtcatcggcaggttgatcagggtcgccagctcggtcttggccagggacaacgcccggcgctgctcctccagctggcgcgtggcctcgatcagcgagcgctggtaggccagggcctgcaccgggtcgccgatgcgttgctggctcatgctctggctattgtcgcgggcctgctcgacccggcccatgaggctgtcgatctgcttgagcaggcgttcggccgccaccgcccgccaataggccgagcgcacgtcctggacgatggtgttgatcaccttgcgccggcgctcctggacgatcagtcgctggtcgccctgctgcttggcgttgatgtagctgacgccgaagtccagcacgttccagaccatggtcaggtcggccaccctgcggtcccggtcctgggaggtcgaaggttccagggactgggtgccggtctccacgctctggctgctggaggcgctgacgttgttgcgccccacgtagccggcggagagggccatgcgcggcagcatgtcgaaactggcgaggtccagctggcgtttggccagggcctcttccatgattttcaagcggccttcgaggttgtacttcaccgcccgggccatggcctggtgcagggtcagcgggccgctcagcggttcctggtccctgtacatgctgtgcaggtcgctcctggcgcgctgctcgctggcactgcgttcgatcggtttactgctgacggcacaaccgctgaccatcagcgccaacaagctgaccccgaataacttctgacttttattcatccttgtctcgcccctgggtgccgcatcgtatttatgtagtgtttcaggcctgcattgcgctgatgccggcctgttcgaacgccctggccagatcgcggatcggccgttgttccgtgtcttgcatcacttgcaattgctgggtcaacgacggtgccccgaacaccccgcgcccgccctgggaaagatcgccggccttgggcttgtcgccgaaagacttcagaaaaccgccatcctcggcggagtcctggtcgaacagcagcgacagcgtgctttggctgaacaccccgccatcgccgccaccaaaacccaggaaaccatggccattgccatcgcccccggcatcgctgctgccgaatacctgggcaatgaagctcggcgccagggccccgcgattgatgaaaatgtcccccagcggccggatgccatcgcccagcaccagctgctcgaacaacggcgcgaaggccagtggcgaagccaggtcgccagcgggtggcgtggtgaccgtgggttgcagcggcacataaggcggcagcggcggaaccaccgggtcgctcgaacggaattccggatcgcccaccggcagctccgtgggtgggttggccgccggcatggtgttgatcgcgtagttgttggagtcggtgctgccagtgccggtattgccgaatgtatcgctcaccccactgttgttcagggtgatcaggttgctggtgtcgctgatgttggcggtgggcgtcagggtcgcggtccaggtccggccgccgtcgctgctgcccagggcgctcagggtgccgttggccaccgtcaggtccgagttggtgaagccgctcaccgcttcgctgaaggtgatggtcacgctgctggtctggcccacgccgaggctgctgttggcgaccacgatggtggcggtcggccgctgggtatcgatcaggtaattgttcgaatccgtgctgcccagcccggtattgcccgaggcgtcgctgaccccgctgttgttgaggctgatcaggttgctcgtatcgctgaggttggtgttcggcgtgagggtcgcggtccaggtgatgccgccatcgctgctgctgagcgcgctcaaagtgccgttggccaccgtcaggtcgctgttgtcgaagccgctcaccgccttgctgaaggtgatggtcaccagggacgtatcgcccacggccagcatcgggttagcgaccaccacggtagcggtggggcgcacggtgtcgatgacgtagttggccgagtcggtggtgccgctgccggtgttgccgacggtgtctatcactccggcattgttcagggtgatctgattgctgctgtcgctgatgttgatggccggggtaaaggtggcggtccaggtcaccccgccatcgctgctgctcagggaccccaggctaccgttggccactgtcaggtccgagttggtgaagccgctgatcgcctcgctgaaggtgatggtgaccgtggtggtttcgcccgctttcagggccgtgtcggccagtacgatggtggcggtcggccgcccggtgtcgatgatgaaattgttcgagtcggtgctgccgctgccggcgttgcccgccgcgtcgctgaccccgctgttgttgaggctgatcaggttggtcgcatcgctgacgttgacgttcggggtgaaggtcgcggtccaggtgatgccgccgtcgctgctgctgaccgcgctcagggtgccgttgctcaccgtcaggtcgctgttgtcgaagccgctcaccgcctcgctgaaggtgatggtcaccaggctggtttcaccgatcggcaggatcgggttggctaccactatggtggcggttgggcgagccgtgtcgatgacatagttgttcgaatccgtggtgccgctgcccgtattacccgagacattgatcacgccgctgttgttcagggtgatgacgttactggtatcgccgacacccacagtcggcgtgaaggtagcggtccaggtgaccccgccatcgctgctgctcaccgcgctcaaggtcccgttggccaccgtcaggtcgctgttgtcgaaaccactgaccgcctcactgaaagtgatggtcaccagcgaggtttcgccagccttcagggccgtgtcggcgatcacgagggtggccgtcggcactacggtttcgatgctgtagttggctgaactggtggtcccggtaccgctgttgccggccacgtcggtgaaaccggtgttgttcagggtgatcaggttgctcaggtcggtgatacccgccgtcggggtgaaggtggcggtccaggtgagaccgccgttgctgctgctcactgcgctcagggtgccattggccaccgtcaggtcgctgttgtcgaaaccgctcaccgcttcactgaaggtgatggtcaccaccgaggtttcgccggccttgagggtcgagtcggagaggacgatggtggcggtcgggcgcaggctgtcgatggcgtagttgttggagtcggtggtgccactgccggcgttgcccgccccatccgtaataccggtgttatccagggtaatcaggttgctgctgtcgctgatactggcagtcggggtgagggtcgccgtgtaggtgatgttgtcgctggtgcccaagccgctcagcgaaccgttggccacggtcaggtcggccaggctgaagccggtcaccgcctcgctgaaggtgatggtcacggtactggtctggcccacgcccagggcgctgtcggcgaccactatggtcgcggtcgggcgcacggtgtcgatcacgtagttgttggaatcggtggtgccgctgccggcgttgcccgaggcgttggtcaccccgctgttatccagggtgatgacattgctggtgtcagtgatgctcgacgtcggggtgaaggtggcggtccaggtgatgccgccatcgctgctgctgaccgcgctcaacgtgccgttggcgatggtcaggtcggcgttgctgaagccgctcactgcctcgttgaaggtgatggtcaccagcgaagtttcgccaattctcagcccggtatcggcgaccacgatggtcgcggtcggcaggacggtgtcgatgctgtagttgccggagttagtggtaccgctaccggtgttgcccgccaggtcgctgaccccggtgttgttcagggtgatgacattgctcgcgtcggcgatgcctgccgttggggtgaaggtggcggtccaggtgagaccgccatcgctgctgctgactgcgctcaaggtgccgttggcgatgctcaggtcggcgttgctgaaaccgctcaccgcctcgctgaaggtgatggtcaccagcgaggtttcgccggccttgagggttgtgtcggcaaggacaatggtcgcggtcggacgctggctgtcgaccgcgtagttgttggaatcggtggtaccgctgccggtattgcccgccccatccgtaatgccggtgttgtccagggtgatcaggttggtcgaatcggtgatgctggcggtcggggtgagggtcgccgtgtaagtgatgttgtcactggtgctcaagccgctcaacgtaccgttggccacggtcaggtcggccagggtgaagccggtcaccgcctcgctgaaggtgatggtcaccagtgaggtctggcccacgcccagggcactgtcggcgaccacgatggtcgcggtcggccgcaccgtatcgatcgcgtaattgttggagtcggtggtgccgctaccggcgttgccggaagcattggtgacgccgctgttatccagggtgatcaggttgctgctatcggtgatgctcgacgtcggggtgaaggtcgcggtccaggtgatgccgccgtcgctgctgctgactgcgctcagggtgccgttgctcaccgtcaggtcggcgttgctgaagccactcaccgcctcgctgaaggtgatggtcaccagtgaggtttcaccgatcctcaaggcgttgtccgccaccactatggtcgcggtcggcaggaccgtatcgatgctgtagttgttggagttggtggtgccgctaccggtgttgccggccaggtcagcgatgccggtgttgttcagggtgatcaggttgctggcatcggcgacaccgacagtcggggtgaaggtagcggtccaggtgatgccgccatcgctgctgctcactgccgtcaacgtgccgttggcgatgctcaagtcggcgttggtaaaaccgctgactgcttcgctgaaggtgatggtcaccagcgaggtttcaccggcgctgagggcgctgtcggcgaccacgatggtcgcggtcgggcgcaccgtatcgatcgcatagttgttggagtcggtggtgccgctgccggcgttgccggacaggtcggcgatgccggtgttgtccagggtgatcaggttgctggtgtcgctgatgctggcgctcggggtaaaggtggcggtccaggtgatgccgccatcgctgctgctcactgccgtcaacgtgccgttggcgatgctcaggtcggcgttggtgaagccgctcaccgcttcgctgaaggtgatggtcaccagcgaggtttcgccgatcctcagcgcgctgtcggccaccacaatggtcgcggtcggccgcacggtgtcgatggcgtagttgttggaattggagctgccctggcccaggttgcccacgctgttctggacgccggtgttgtccagggtgatcacattagtggcatcggtgatgctggtgctcggggtgaaggtggcggtccaggtaatgccgccatcgctgctgctcaccgcgctcaaggtaccgttggcgacggtcaggtcggcgttggtgaaacccgtcaccgcctcggaaaaggtgatggtcaccagcgaggtctcaccgatcctcagggcattgtcggccaccactatggtcgccgtcggatgcgcggtattgatcacgtagttgcccgagtccgtggtgccgctaccggtgttgccggccaggtcggcgatgccggtgttgttcagggtgatcagattgctggcgtcgctgatgccatcggtcggggtaaaggtcgcggtccaggtgatgccgccatcgctgctgctcactgccgtcaacgtgccgttggcgatgctcaggtcggcgttggtgaagccgctcaccgcttcgctgaaggtgatggtcaccagggaagtttcgcccgccgtcagggtgctgtcggcgaccacgatggtcgcggtcgggcgcacggtgtcgatcgcatagttgttggaatcggtggtgccgctgccggcgttgccggccaggtcggcgatgccggtgttgtccagggtgatcaggttgctggtatcggtgatgctggcgctcggggtgaaagtgccggtccaggtgatgccgccgtcgctgctgctcactgcggtcaaggtgccgttggcgatgctcaggtcggcgttggtgaaaccgctcaccgcctcgctgaaggtgatggtcaccagcgaggtttcgccaaccctcaaggcgttgtccgcgaccactatggtcgcggtcggccgtgcggtgtcgatcgcatagttattggagtcggtggtgccgaccccggcggtgcccaggccattgatcaccccggtgttatccagggtgatgacgttgctggtatcggtgatgctcgacgtcggggtgaaggtggcggtccaggtgatgccgccgtcgctgctgctcaccgcggtcagggtgccgttggcgatgctcaggtcggcgttggtgaagccggtcaccgcctcgctgaaggtgatggtcaccagcgaggtctcgccgactttcagcgcggtgtccgccaccactatggtcgcggtgggcggtggtgcataggcggtattgaggttgccgccgtcgttgtagatggtcgccaccgacgtcggcgaagtaccggtgctgccaccgcccaacgctacgccaccggcgccactggccgccgcgttgccgctcagggcggcgaagttggcggcggtgatcaggaaggtgcccttgttccagaccgcgccgacgccgcggccgccaatcccgccattgctggcgttactgccttggccgccaccaccgccaccgccgccgcccgcgccgatgttgttgctgatggtcgaggtgccgatcaccgtgagggtgccgctggaggcgttgtagatcccgccggcggcattgccgcccgcgccgccgaccttgtcccaacccgcgccgccgccaccgccgccgatggaaatcgtgccgttggtggccgtggcgccgttgccgccgttgctgtagtaggacacgcccagaccgcccgcgccgccagtgctggtaccgccgcgaccgcccatgtgggtggcgtcgtagccaccgccataaccgcccacgccaccgccgccagcctggccgcccagcgtgccggtgccggggccggcggaaccgccgtggccgccaccctggccacccaacccgccgccaccaccaccgccaccgccgtagaacgcgccggtgacaccgccgccaccgccgccgcccgaggccgcgttggaggtcacggtgacgttgttgagggtgaggttgccggcgttgaaaatccccccggccatggcgccggtcgcgccatacccgccattgccgccgttgcccgagaccaggccccgggtgattaccaggccatcgagggtcacggtactgcccgcggtcacttcgatgacgcgggtgcggtactggccgtcgaggatcacgtccgccgcgccgtcgttgttcaggtcgccgtcgatggtcacgttcttgttgaccagcagttcggaggtcagctgcaccgtcatgccgctgctgaaggtgacgatgtcgccgttctgcgccgacgccagcgccgcccgcaacgaacccacgccggtgttggcgttgttggtggcggtccaggtcgccagcccccactgataatcctgcatggcctgggtggacagcacattggcgctttcgatggtgccggtggcgatctccagttcccagtcgccccccaggccggtgcggtcgctggaggcggccacgtcgcgaccggtgagttgcgccagcgagtcgacgaaactcaggccgcgttcgccctcggcggtgtagcagccgtagatcaggatatcgccgccggcgttcatgtcctggccgatgtccgccagcaccgcgctgcgcgcctggacgttgtcagccgagaggtaactgttgcccagccacaggtcgccggcattgccgtgggcgatgatctgcaccgaactgacgccctggtgctggtccaggtaatcggcgatctgctgcaggccatcctggttcgcccccagttgcaccacctgggtgccgggcgccaggccctggagcagactgtcggcgtccttgacccgcgagtcgacgaacaccaccgtcagccccggcaccgcggtcggggccgcggcaggcgcggcatcggcctggccgtgggtgtcctggctgacgctcggctgatcggcggcggtcggcgtcttggccacgtccgtggtggtgtggctgtccggctgggcgacatcggccaccgtcgccgccaccgcaccgtcgaacaacatgcgcggctccagcggcatgatcatcggagaggccagggcattcgcccgcccggtggcccgctgattgacccgcgacttgcctttgctccaccacatgatgctcacccggactcgaacgtgctgaaaggtgcgaattgaaaaaccgcggtcaacgggccgcggcgtcggatttcatacgaatgacattggcggcactggatgccccgtctttccagaaggacagctccgcatacttctcgaacaggtccggcggcaggatggtgcgccgcgactgcagcgccacccgcgccttgaccttgtgcaggcccgcgacccccagcgcctggtcgaactcgggcgcgtcgtaggccaggctgtcgaaatcgtgttcgaaccagggttcgtcgataaagtcgtagatcagccgcatcacccgctccggggcctggctcagcaggtcgtagtcgacgatcagcagcgaatcggcgttttcgccgtaataggcttctttcaaggcggtccaggcataccccaccagccgattgtgctgggccagggtttcgcagcggctgtagaccgaattgcgctcgaccgcatcgccgaacagcttggtgttttcgaaggggttggcccggtacagccgttccaggctgtccatgacccaggcgacattgcgcacacaggcgatggtcctggccttgggaaacaggtccttcaaggccggcaggcgcgcgcaccattggcgattggtgtcgaagacgacgggtttgtcggccttgtcggcgtagtaggagtcgaacagcccgcgcagcaggcggcggcgcatatcgatgtcgatgaccgcgccgaattcgctgccggcgctgcattgttcgaggatgccgctgaacagcgcccccaccgggctggtcatgccggcgtgaaaacgcgggttctgcagcaggatggccgacagcagggtcgaccctgagcgcggtaaaccggagataaagtggaactgcggcaatcccttcaccctagctataagtccatttgtaggaaaaagcgtagtgcaaggtcagaaaaccaactagtggtgctttgatatcaattcgaagcaaaaaccataaaaaacgtgtgttttaaaaacacccaccgctctggaaccgaacgtgaaccgatcaagccactgctggccctgaattctgcctttcgtccatcagttggttcacaggccgatcttttgcgcaaaaccgcccaaggccgctatcccgcaggtttcccagcctgggcgcacagtgcttgcagcgacggctggccctgcgccacgccgcatatcaccagcaaccgcgccgtgaccccgccggcggtgaattcgccggcttttcgccattgcgccggcagcggggcgaattcgtcgggttgctcggccgtgccgatcagccagacgcgaccactgcccaccggcagcgccgacagccggtcgaggtaaagcctgtcagcctgctgctcgaccagggtgccgaaaccataggcgttgggccgggtggagacgccggcgggcgtgggcggggtgtagagcagcggctgggcgtcggtacggttgtagtagacgtagctcaggtaccacagcaggtcgctggtgacgatccggtcgccggccacgtagcgctggttcacgtagtccaccagcacgctgatctgatcgttgctatccaccgtggcgttgttgttcagaccgaccccctcggccccggcgaacagcagcaggaccgccagcgccagcgcgcgggcatgcacctgggcatgctccagcagccggtcgatcgccatcgcgaaaagcagcggcaggcccagggcataggccgtcaggtagcgctcgatgaacaccggcgaaacgaatgacaccgcaaacaccagcaacagcggcagcacgctgtaggtcaccagcagccagctccagcgccagggcgtgcggtcgcgccaggcgagcattgcaacgacgtccagcaccagcagcggcaggcccgcgaacagcagcggggaacggctttcgccatcgtcctgggtcagcaattgccagaccatcgagggtaacgacaaaaagtccaccgacggctcccagcccacgtcgccgctggctttcagctggtcgatatgctgcagcaggtccaccagccccggcagccagggggcgaacagcatgacgatggcgaggttggccagccaccagccctgctggctgatcgcccggctcgcaggcgtcgcgtgcaggcgtagcagcaacaggtacgaccagtgggcaagcacgcagagcgcggtgaaatagtgggtgtaaaacgccgcgctcatcaacagcgtgtaatacaccaggtagcgctggcgccggggctgcctgagccagtacaccagggccagggtggcgccgagcagccacacccccaacaaggcatacatgcgcacttcctggctgtagcgcacggcggtgggcagcagggccagcaggaacccggcgaggatcgccgcgcggcggctggcgatctgcgccaccagccacacccccaggccgacacagacgatccccggccaggcgctgaaactgcgaatggcaaagatgccgtcgccaaacagcgcgatccagccgcgcagcagcatgaagtacagcggcggatgcacatcgtgggcggcatgcacccagagttcgctcaggccgtagcggctgagcaacaggctggagccttcatcgccccagatggccgcggcggtcaggtcgtagaaacgggtggccgccgccagcaacaaaatcggcagcagccagtacgcccgcagcaccgcgaccaggcgctgtacgtcgctcgtcagccgatgggcgatgcccgacccggccgtatccagcaattgcggctctctgcgaaacgccatgaatgtcccctgcaccaacgttttaccagcacagcatcgcggtttatccggccagacataaggcatcccatcaccccaggcgactggcggagcagcgtctacgctaaccattgctgtcgacgagcccgcttggcgttctgaccgtatcggtcaagctgtcaggccagacaccagggatcggctcagggagtcccactgattaacctgaaggataaaaaactatggaagtgttcatgggcaccattcaagctttttcctttaacttccctcccaacggctgggcctcgtgttacggccaaaccctggggatctcgcaataccaggcgctgttttccctgctgggcacctactacggcggcaacggcaccaccaacttccaactgccgaacctgcaagggcggctgcccatcggccagggtaacgggctgggcctgacgccacgggtgatcggcgaggtttccggtaccgaaaacgtcaccccgaccctcaacaacctgccgtcccacacccacaccctcgccagcgtgagcgccgccaccacgctgcaattggccaaccccgccagcagcccggtcagcgtgccgacggccaccaattcattcatcggcacctccggcggcgggccgggcaccgcgaccatctattccgacagcctgggcgccacgccggtgcctctcaagggggtcagcaccacgatctccggcaccatctcgcccgccggcaacggcctgccgctggaagtcatgaacccgttcctggtgatcaacttcagcgtggccctgaacggcctgttcccatcgcgcaattgaggttcgcgccgggggacattcccccggccctttttccggccaggagtggcgccatgctgcatctgctgcaaagtgagcatttccagcctttgctgggacaaacctgcaacctgttactaccggacggcagcgtgttgccggtccatatcgagtccatcaaggacaccccccaggcccgcatgccgaacagcgcgcgcatgcccttctgcgtcgaactcaacagcctggagccgacggagttcgtcgacggcctgtgcgacctggagctgcccggcgtcggccatctgcaagacatgttcgtgtcgcgggtgccggccctgggccgcgacccgacgctgggttatttctacatcgccttcaactgaaccgggcgtgcctggcggcatcgccccaggcactggctcgaatccgcgggcttgcgccgctcaaccgcgcgggccgggataccacaccagccgctcggccgccgggttggcctcctcgacctgaaaccccagcgccaggtaatgccggcgcgcatgggggttgctggcccagaccaccgtggccaccgggcaacgcacctgctcggcggctttctgcacgccccgcagcacggtgcgcccgtaaccgcgaccacgagcggcgggaatgaacgccaggtacagcacgcggatttcattggggccgaaatcggtggtcagggcaccgatggcgctgccgagcttttcgatcacgtagtgcatggcgccagggaagttctcgcccgcaccctgctcctgaacctggaactgctgggcgatcacctgctcgatctgctcctgctcgccatcgatccattgcagatcgctgcgcgccgaacggtaaaggctttgcaggaagggtccgtcggtgggccgcgacggacgtaccaccaggccatcggacatggctgaatccttatgcaacatgtgcgttctccctgaacattccttgtttcagaacccgctttccctcacgcccagcgctgccagacgtcgccaggccgtgcccagcagcgactcgccacgcccctgcaacaccaccacgccgcgcagcggctggctcggggtgacgctggcgtcgagcaccttgagccgcgcgccgtactgcgcctggaccggttcggcgcggcggttttcatcgcggcgcacggcaatcggcccatggtgatcggaggtcagtgcctcctggtcgatataagccacgccgttggtgtcgacttcggtcagttgcacctcgagcgccgggtgcatcgggtcgtcggcgataaagcgtcccgtggcgcccggtgcgactcgccacaggtccgcctcggcgaggaagccgcgcaaacgcgcccccggctcgaccacccgggccagcggctccttgggcgagacccagcggcccacctgcagttgcggcagcaagtcacgcagctgaccggcctcgggcgcgcgcagcagcaggcgctcgcgttgcgccgacaggccgcggtattcggccacggcctcggccagctgctgctcgacaatcccggcgtcggccgcggtctcgctgcgcccggcgcggcggcgcatctgcaattgctggatctcgatttcccgccgggcgatggcctggcgcgaggccaggtccggggattcgagctcaaccagaacctggcccttgctcaccgcctggccgtcgctgacattgacctgccggacccgcgccgccaccggcgcatgcaaggcgctggcgcgtccggcttcgagcatcgccggtacctccaccgagccgcgccagggcaccgccaccagcagcagcgccgccaacaaccccagaccgctgagcaacacccgtggcgcgtgggcctgttcgcggcgcgtccaccattcgcgccattcccgcacgatgggcaaaaagatgaaccagaccagctccaccagcatcaggaagatgcccagcagcttgaaaaacaggtggtacaccgccagcgcaatcccgaaaaacagcaccgcgcgccacagccacgagccataaccccaccacagcagacgccgctgcatggccggcgaccagggctccggcgccggctcccggtagccgaacaaggcctcgcgcaggcgccagcgacagagggcgaaggcccgcccttgcaggttgtccacctcccagaaatcgctgagcagaaagtagccgtcgaagcgcatgaaggggttcaggttgatcaccagggtggtgatccaggtggcgctggcgagcatgaaggccgcggtacgcgccgggccgtccggcagcagcgaccaggccagcagggcgatgctggccagcagcagctcggccagcacgccgccggcgccgatcagcaagcgcgcgcgacggtcattgacccgccaggcatcgctgacgtcggtgtagaacatcggcagcagcaccatgaacgccacccccatgctctgcacccggcaaccggcgcgcttggccatgaaagcgtggccgaactcatggcacagcttggcgaagaacagcgccacgccgaacgccagggcgccaccgaggctgaacaggtggggaaaggtcgccaggaagcgctgccagtcccgcgacaccaaaaacacccccagccccagggtcagcggcaagccgtagcgcagcagccccgggccgaaccgcgccagccacggccaggcgcgattgagaaaggcgtccgggcgccacagcgggatacgaaagaacaggtattggtgcagcagcacctgccacaggctctggtgctgcgcggcagccttgagctcatagctggcgcgctgctgcggatcgagggcggtgatcaggtcatggctgcgcaaaaagcccagcagctcttccagttccacgccgcccaggggcagccctggctcgcggttggcggcgcgcagcacctggttggcatctcccagggaccagtgcctgagcaggcgcatcgccgccgcgccgagcttgaaatagcggccgcgcaccgggtcggccagggtccagcgcggcgaaccgtccagcgctggcgccgccggcgacagctgcaagtccgcgcgcaggcccggcaggttcattacaggcccacgctctgccgcagaccggccagcgggcggcgcagcaggtacagcgccagcggcgcgcgctcaccgaagagcttggccgtgccgcgcaggccgatccgcggcggcgcgtcgcgaaaacgcgcatcgaggcggtaggccaattgcccgcccggcgtcggctgcgcctcgtaggccgcccgttcgaggctggccagatggcgctgcaacgggtcgctgtcgagaaacagcgccacctgcgcgccgggctccagggcaatggcatcgcccacggccagttcgatgcgcaactcggcctggctcgggtcggcgatttccatcagtcgctcgccggtctgcaccggtttgccggtccagcgctcggcgtcggcgaacaccgcgatgccatcgcgttcggcccgtacttcgctgcgcttgagcaattcgcgggcgtaatcgcgttcggcgcgtttctgttcgacccgggccgccaacaggtcgatcttcgagctggattcggcatcggcgaaggcccgctgggaattggccttcagttccgcctcggccacgcccaaggcgcgggcggcgacatcggcctgggcattgagggtggtattttcgaaacgcagcagcaggtcgccggtcttcaccgtctggttaggcttgaccaggaactcggcgatcaccccgtccagcggcgccgccaccacacgcccgcccagcggcaccacttcggccggcgccagcaccgattgccggaccggaatcagcaagcccagcaataccaccgccaacagcgccagccggcgtttgcggttccagcgcaggcgccacggcttgcgcggttgcagcgccagccaggcgtggctgtaggtgtcgcccagttgcgccagcaatacttgttcggaagggttccacggattgtcgcgggccagccacaggccaccaaagagcgcgccctgacgatcgatcagcggcaaccagaacacctgcgccgccgacaggctctgccagtcggcccgtaccggggcgctcagttgctcggccgcgaccacccgcgcctgctgcgcgagttcgagcttgaacagttgggccaccgcctgttcgacgaaagccacgaaggccgcattcggatcgagcgcgctgacgccagtcaccgcgcggaccttgccggcgatcaccagggccgcgtggcgatagccgaacagtgcctggctgtcgttgaccaggctgtaggccagttgctcgaccgtgcgcgcggcgcgggtctggcgctccaggtcgaggaaccgggcgaacacctgctcggcggcgcccgctaccggcgcgttcatttgagctccgcgaaccgcgccgtgccgctcatgcccgccaacaggccctcggcgttgggtacggccgccaccagcagcagcgtctggctgccttcgtcgatccgcgcgccgaggcgcttgaccgtggcggccagcggcttgccggtttcatccgggacgaagctgaaggtctgcccggccttgagcttgcccatccagctcgacggcaccagcaggtggatttccagggaacggttgtcgacgatttccagcagcggcgagccggccgtcacgctttcgtagcgctgtaccttgcgcgccaccacctgcccgtcgaacggcgcgatcacgctacaacgcttgacctgcacctggtagacctgggattgcgcctgggtctcggagaccttggccgcggctcgcgccacttcgaagcggccgaccgagttgagcgaagccagttggcggttgtgcgccagctcttcgttggcgccacggctggcggcctgggcggcattgagctgggcctggtaggccgagcaatcgaagcgggccagcacctcgcctttcttgaaggactcgccttcgctgtagggcagctcgacgatgcgcccggacagctcgccggccagtaccgcctgatccttggcccgcagcacgccgcgcgcctcgctgccgctggccacggcggcgccggcagcgctgtcactgatcagcggatcgtctggcgcaggtgtctgcgcctgtgccaggcacgccagacaggtcaatcccaatcccaatccatgaaatcgccgcataaccgtaactccctgacggatggggcggagtctaagacagcaagcacaagcgtcaagcaagtggccactatctttgtcgatcccgacaacggcatcgagcgcccgcctgacagcatagatgccttgtccggcacggcgtgtatcggatcgtgtgggtattttagatgccagcgaatgccttctgtatgatttgcaccacacttggaccttcgactcccatcgtttcggattaaggacaattcatgcgtatcggtcttttgtcgtctttgacactggcgctcggcgccctcctctgcaaccaggcccaggccagctccgacgattcctgttacccgcgctggaccctggtcaaaaaaaacctcgacagctgcagcagcctgccgtttctcaacccgggcaacgacagccgggtgaacctgcgcctgttgctggccgacagcggtgccttgcccctggcgccgaaagcgctggacgccgatagcctggacgagggttatggggcggtgccgtttccagtatttcgcctgcaacccgcgcccagccctgaggacgcggataccgcgcaaaccccggaggacactgacctcaacggccgcctggagtccttgcaggtggtgcgcgaaaccccgcaagcagccggcgatgccttcctgtccggcgaaggcagccgctgccgaagcaactcggacgccagcgcccaggccttcgtcgaccaactgatcgccgccgacctgccggccagcgaacgccaggcgctggcgcagagccgggtcaagctgctcgccgcgtgcaactgggacagcccgcaactggccagcctgctgccgaccgacctgcagacaccgctgggcaagggtttcgccacttatctacaggccgccggcgacttctacagcggccgcttcagcgaggctggcgcggcgttcgccacgctcaaggacagcccgaatgcctggctgaaagagactgcgctgtacatgaacgcccggacgctcctaaacagcgcccagcagaacgccttcgacgaatacggcatgccggcgctcgagcatgtggataagtccaccctgcaacaggccgaggccggcttcgacgcctacctgcaaacttatccacagggtgcctacgtcgcctcggccaagggcctgctgcgccgggtgcactggctggacggcaatcccgacaaactcgccgccgactacgcctggcaaatgacccaggccaaggacgagcagcgcaacctgtcgctggacgatctggtggaagaagtcgacaccaagctgctgatggtcaaccgcaacccggtcagcacgcccctgctgctggcggtcaacgacctgatgtggatgcgcgagcaagccgaaggccggctgacccgcgacgccttgcaacaacaaaaggcggtcttcgccgggcaaccggcgctgtacgactacctgcaagcggccttcgccctgtacgtcgacaacgatcccgacgccgcgctgaaacttctgcccgccgagcctgcggccaagctcgactacctcgccttcagccagcagaccctgcgcggcctggccctggaagcgaagaacgacgcctcgggcgcacaggccctgtggctgcaactgctgcccctggccaagcaaccgctgcaacgggaacagctggagctggccctggccatgaactacgagcgcaaccagcaactggccaaggtgttcgccgccgactcgccgatccaaagcccgcaggtgcgcttcaccctgctgcgccatgtggccgacgccgagttgctgcgccagcagatcggccaggccgccgacccggtggaacgtaataccgcgcagttcgtgctgctctacaaggacctgctgcgcggccagtacgcggcctttgccagcgaccttgggcagcttcccgccagcgcccctgaagacaagcttggctacagcctggggtacgtctatagcaacggccagtcgctcaagctgttccagtggaacggcaaagaggccgagtccggctacgtctgcccgagcctcgcagaaaccgcggcggcattggagaaggatgggaaaagcccgcaaggcctgaactgcctcggtgagttcatcctgcgcaacggcctggacggcatgccgctggacagccagcccgacaagcagtccctgggcggcacgccgtcggctttcaagggcgaagcgttctcccgcctcgagggctacaaacaggtgatcgccaacagcaaggcgccacgcgacgaccgcgcctacgccctgtaccgcgcgatcaattgctttgcgtcctcgggcaacaaccgctgtggcggcaaagacgtggagcccgcggtgcgcaaggcctggttccgccagctcaaaggcaccttcgccgacacccagtggggcaagtcgcagcagtactactggtaagcatgagccgcttctggcgatgcctgctgccggtctggctgttgctggccggcagtgcccaggccgcggtcgacgcccgcgatcacgatgccttctggctgtggagcggcgtcgccccgcagccggtgctgaaccaggccaagaccctgtacatcctgcaagggcagatcagccgttcgcgtcgcgacccgagcggcaacgtgcacttcatcgcccagggcatggccgttccgcgcctgcgccagggcgaggtctgggtggtctatcgcgcccacaccctgcactggccggaaccggtctaccgccagctgctgggccaggtgcagcgctggcagcaggccggcaacccggtggtcggcatccagatcgatttcgacgcccgcacccgctacctcgacgagtacgccagcttcctgcgcgacctgcgccagcgcctgcccgcccggtaccgcctgagcatcaccgggctgatggactggggcagcaacgccaaccccgaggccatcgccgggctcaagggcgtcatcgacgaagtggtggtacagacctaccagggccgtcacagcatccccaactacgccgcctacctgccccgcctcgaccgcatgggcctgccgttcaaggtggggctgatccagggcggcgaatggcaggagccgggctatctgcgagacagcccgtggttcagggggtatgtggtgtttttgcagaatccgcgctagccaacggatacgccgactcccagcctccgcccagggccttgtacaggccgaccatggccagggaaacgccggtcgagctttccaccagttgttcctgggtggcgagcaaggcgccctggacggtgaggacgttgacgaagtccaccacgccttcgacgtattgctgttgcgcggtgcgcagggcgatctggttctgccgcacggcttcggccaggctgtcgtggcgcagctggctgctgttgtagcgggtcagctggtcgtcgatttcatgccaggcgcgcaacacggtctgctggtaggcgacggccgcttcctgctgctgggcttcgcgcagatgcagcatgccgcgcaggcggccgccgtcgaacagcggcaggctgaactgcgggccgatgccgaactgccgcgagccccaagagccgaagtccgacagctgcatggcctgggagccgaagttgcccgacagggtgatgcgcggataaaagtcgcccttggccacgccgatgctggcggtggcggcatgcaggcgggcttcggcctggcggatgtccgggcggcgttcggccaattgcgacggcaggccgatggcgacctgacgcggggtttgcggcaccggcgcatccgccgccagctgcgcatgcagggcctggggcggctcgcccatcagcaggctcagggcgttgatcagttgcgcctggcgctgctgcaaggccggcagttgcgactcgatggtcgccacctgcgcggcggcttcggccacgtccaggtcggtggccacgccgtcggccaggcgcagttgcgagagcttgaggctgtggcgggcgacgtcgaggttctgctcggtcaccgcgcgggtactctgcacgccgcgcagctggatatagtcctgggcggtctcggccagcaccgacagcagcaccccacgccggtcgttctccgcaacttccagggtcgcgtcggcggcctcggtttcgcgccgcacgcggccccagaaatccagttcccaggaagccgagaagccggcgtcccacaggttgaaggcggacttgccttcgtgacccgacgggtcgttcaggccttcgccgctgttgcgtttgcgcgcgtagccgccgctggcgctgctggtcggataacgctcggcggtgaccacctggcgcgccgcgcggctctgttgcaggcgactggtggccagttgcaggtcgaggttgtcggtcagcacgcgccggctcagggccgacaactgcggatcgttgaagacctcccaccagcgctcgtccagggggctgctcaccacctggctcggcgcagccttttgcgggctggcccaggcctcgacccgcggcccttcggggcgctggaaatccgggccgacactgcaggcggccagggacaacaggctcagggcgaataccggctggagcagacgactcatcgcttcgccacctcacgcgcggagctggcctggcccagggtatcgacgctcgcttccaccgacatcccgacccgcagacgctcggccatcggctggccgggctccagcaggatcttcaccggaatgcgctgcaccaccttggtgaagttgccggtggcgttgtccggcttgaccgcagcgaaggtcaccccggtggccggcgccaggctctcgacccggccgcgcagggtttcgccgtccaggctgtcgactcgcacctgcaccgactgcccggggtgcatgtgggccagctgggtttcctggaagttggctaccacataggcctgctccaacggcaccacggcgaggatcttgctgcccggcgtgacgtaggcgccgacccgcaccgcgcgttcgccgaccatgccgtccaccggcgcgacgatgcgcgtgtaggacagctcatagctggccatttccagggacgcctgggcgcgcttcagcccaccctcggcggcgtcgcgctgggcggtgaggatctccacctgcttgcgttccgccgccagcgccgccgtggccgtggccagccgcgcgctggcctggtcgatgcgggtccgggcctgctgggcattctgcaccgtgccggcgccgaccccggccaggtggttgtagcggttcagttcatgttcggcgaaggccatttccgcccgtgcggccaccaccgaggcctgggcctgggcgatcaccgagctttgccggtcgagggtggcgcgggcgttctgcaactgcgccttggccaccagggtttcggcgtccgccgcctgggccgcggcgcgcaggtcgcgatcgtcgatcagcgccagcaactggccggccttgacccgctggttgtcttccaccagcacttccttgatgaaacccgccacgcgcggcgccactagggtgtagtcggcgctcacgaaagcgtcgttggtggtctgctcggtggccttgccggtgaccaggtacaccagcacgccgaggaccgcgaccgcccccacgctgacggcgattttgtgtttgatgtggattgtcataaaaaaccttctgtctcagtgaacgttcaagtcggcgcgcgtggcggatagatccgcgtcggcagccagaaaatcagcaggatcaaggccgccgccacgccagccatgacgtagtagaggtcggcggaggtcagcaccacggcctggcggtgcaggcgctgggcgaggttgctggcgtcgatggcgctcagcggcgagttgccgaggctgtccaccagcatggtcgagtgaaagtgcaggcggtgggtggtcagggcatccagcacgccggtggcgattaccgccgccaggcccttcacggtgttgaaccaggaggacgcgaacggcccctcgatcggctggatactgccggtggaaagcatcagcagcggcagcaccgccatcggctggccgaagatctgcaacagttgcagcacgtagaaatcgtcacgaatccacgccgaggtcagctgcgcgccgcccaggcacgacagcaccagcatcgtcaggccgatgcccagcacccagcggcaatcgacccagcgcaggttgcacagggccgccaccaggggcaacgcgagtagctgcggcagggccatcaccagcatcaccggagcggtctgcaacggccggtaaccctggacctgggccaggaaactggacggaatgatgatcaccgcggtcagcaccaccaataccccggccagggtcagcagggcgaaggacaggttgcggatgccgagcatctgcaacttgaaaaacggaatcggttgcgaccattcgttgatcagaaacagcaccagcaacaacgtgcccccgcccagcagcaggcagatcagcggcgagccgaaccagtccaggcgattgccctgcagggtgccgatcaccagcatgcagatcgccggaaaccccagcagcaggccgcgccagttgaaggccttgaggcgctccaggcgcagcggatcctggggcaggccgtaggccaccgcgagcatcgccagcaagcaaggcaccaccacctgccagaacgcccattgccagccgacgtattcggtccacagggcggccagcggcgtgcccaggctcgggccgaaggtggcggtcagggcgtagccggccaggccgtagagcttgacgttggccggcaggaaccgcagcgccacggtcatcagcattggcggcaacgcgccgccggccaggccctgcacggtgcgcagcagcaacaggctgtggtagttcggggcgaacggacagagcacacccagcacggtgaacagggcgatggcgcagagggtgaaacggcgcagcgagaaggtcaccgaacaccagggcgcgaaggccatggccgccaccgaggtggcggtgtagctggccaccagccaggtgccttcgtcatagccgatggccagggcgccccggatatcggccagggcgatcttggtcaccatttcgttgaggcccgacaccagcaccgccagcaatacgccgagcaggccgatgataattcgtgggccgaagaccgcggggctggcagctgccggtttgctggccacttcagcgggcgccggcacagccacggcgagggaactcatgaagggaatgactccgatagaaataccgaagcagtgtaaaaagcccgacagctgacgaaaactgacttatcggcagcttataagtgcaccgtacgcaatgattggatgacgtgtagccgctgccgagcaacgcgaggctgcgatcggcggcgcagccgtcgcaacaccaggcgacctgatccaacaagccaatcgcgggcgctgcctggcgagggctaagtcggatgccgccgaccccgttcgcagcctcgcgttgctcggcagcggctacagggggtgtggattcagggctgggcgacgtgccaggtttcgttgcaggaggcgcgcagggtctcgcggaaccacttgtgcgccgggtccttgtcgtagcgcgggtgccaggcctgggtcagcaccagggtcggcaggggaatcggcaaggcgaaggaacgcaggtgcaggcccaggcgcgacacgctgagcagggtttccttgggcactggcaggatcaggtccgagtccggcagcatgaacatcgcggcatggaagctcggcgcgatcagcggcacccggcgctgcaggcccaggtcgctgagcgccgcgtcgatcggcccgcgggcgatgccgcgccgggacatgctgatgtgcgggaaggcggcaaaacgctcggcggtgatctcttcgtcgagcaatggatgatgctcgcgcaccaggccgacaaaggtggtggagaacaggttctgcaccttcacttccggggtcagcggccgggtgttgctgatgcgcaggtcgatccgcccttcgcgcagggcctcgtcgtcgccatcgccctccgggacgaaacgcagttcgcaatggggcgcctggcgctccagggtgtcgatcaggcgaccgccatagacgccgacgaaaaagtcgttggcgcgcacattgaagcgccggcgcagggtgccgaggtcgacctggtcaccggaacggaacaccagcgccgcctgctccaccaggtcgcgtacctggccgcgcagttccagggccttgggcgtgggcaccaggccacggccggcgcgtaccaggatcgggtcgcccaatgcctcgcggatccgcgtgagggtccggctcatggccgccgggctgaggttcatgcgccgcgccgcgccgaccacgctgccctcgtcgagcagggcgtcgagggcgaccagaaggttcatgtccgggagttgcatgctgagcactcgtggctgatcgggaatgagtcaggcgcaatgctagcagggtcatttcagtcatgaacaccactcttctgtagccgctgccgcaggctgcgaacgaggacaaagtcctcgccagacctgcgcatgcggtatgccaggaagaatgtgccgtcaggttttgcgccggctacgccgtcgatcgcagcctcgcaagctcggcagcggctacaggatcgtggagggcagttcaaccgtggacaccactctgtgtagccgctgccgcaggctgcgatcgaggacgaagtcctcgccaggcctgcgcacgcggtgtgccagacaacatgtgctgtcaggttttgcgccggctgcgccgtcgatcgcagcctcgcgggctcggcagcggctacgggcgctacaggttcagcgttgcatgccccagcgtttcacggtgacccgctccagggtgtcgaacaccaggttttccaccagcaggccgatcaggatcaccaccgccaggccggcgaagactttgtcggtgtacagctcgttgcggttctggaagatgtaccagcccaggccgcccttgccgctggtggcgccgaacaccagttcggcggcgatcagggtgcgccaggcgaaggcccagccgattttcaggccagcgaggatcgacggcagcgccgccgggatcaggatgaacagcacgaagcgcatgcccttgagcccgtagttgcgcccggccatgcgcagggtttccgagaccccgagaaagccggcgtaggtattcaaggccagggcccagagcaccgaatgcaccagcacgaagatcaggctgttctcccccaggccgaaccacagcagggccagcggcaacagggcgatggccggcaacgggttgaacatcgaggtcagggtgctcagcaagtcgcggcccacctgggtcgacaccgccagggtagtcagggcaaaggccaggacgatgccgatcaggtaccccttgagcagcacgaccagggagatgccgaccttgcccagcagctcgccgctgagcaggccgtcgtacagcgcgctggcggtctgcaaaaagctcggtagcagcaggtcgttgttctggtagcgggccacggcctcccagagcagcgccagcacgatcaggatcaggctcttgcgcagccagccttgttgccacaggcgctggcccaacggcaattcacgctccagcggcaccgccagcaagggttcgagggcaacttcgtattcctggcgaacaggtgatgaatggctcatcgggcgttcctcttaaaggctcaataagcgatacggatatcggagaaatccagctcgcgctcggtttccggcgactggccttcgtcgaacagcagccggtggatgcgccgcgccgtttgctggaacgccacaccgccaaggctttgcaggtcgtactgatggctgtggatttccgcccgcacccgccccggatggggcgacagcagcaggatgcgattgcccaccaccagcgcttcctcgatggagtgggtgacgaacagcagggtgaagcgcacctcttcccagagcagcagcaactcctcctgcatcttgcgccgggtcagggcatcaagggcggcgaagggttcgtccatcagcaggatcttcggctgcatcgccagggcgcgcgcgatggccacccgcgccttcatgccgccggacagggtgtgcgggtaagcgtcggcaaacgccgccaggccgaccttgtccaggtagtgcagcgcacgctcctcggcctcgcggcgcttgagggggttcgatgccagcagcgggaacatcacgttctgcttcacggttttccacggcggcagctgatcgaactcctggaacaccacgatccggtccggccccggctggctgacccgctgtccttgcaggcgaatctcgccctcgcagggctggatgaagccggcgaccgccttgagcagggtcgacttgccgcagcccgagggcccgagcaggacgaaacggtcggcgggatcgatttcgaaactgacctggtgggtggcccgcaccacgcgctgcggagtgcggtattccaggctgacctggtcgaccgccagcagcgcctgggccgccgtggtcgggttgctggccgtgtggccttgcaagggggcgttcatggcgatcagctcccttgcagcggggtggtgtcctggaagaagtagtccttccacgattgcggcttgttcttgatcgcgcccacgcggtagaggaactcagccagcgggtaggtgtttttcggggtgacggtgaactcgaactgcgggttgtcgatgatcttcagcaaggcttcgcggtcgatcttggccttggtcacgcggatgtaggtatccgccgccgcccccttgtccttctgggcgaagtcggcggcctcggccagcgcctcgacgaaagccttgtaggttttcgggttctcgctgcggaatttctcggtggcgaacagcacggtcggcgagttcgggcccagcaggtcgtaggtgttgagcaccacgtgcacattcgggttggccagcgcctggtcctggaacggcgggttggagaagtgcccggtcagctcggtgccgccggcgatcagcgccgccgtggcgtccgggtgcggaacggcgatggtgtacttgtccaggcgattgaattccttatcgccccactgcttggccgccgcgtactgcaggaaccgcgactgcacggaaacccccaccgccggcaccgcgatgcggtccttctcggtgaagtcggcgatggtcttgaccttgggattgttgctcaccaggtagtaagggaagttacccagcgacgccaccgccttgacgttctgcttgccgtgggtgcggtcccagatggtcagcaacgggccgacgccggccccggcgatgtcgatggagccggaaagcaaggcgtcgttgaccgccgcgccgccggacagctgggtccagtcgaccttgatgtcgatgccctcttgcttgccgtgtttttcgatcaggttctggtcgcgcaccacgttgagcagcagatagacgatgccgaactgttcggcgatgcggatctcgccttcggcatgggccgccgtcggcgcgaccaggccagcggccagcaggctgaagcccaggccgatggcggccgccagtttgcccaggcgcgggaggcgttgagtaggttgggacatggtgtttctcctgccgtgggtggccgatcagtaaggggcgtcgccctggatggtggtgcggtacagcttgcggcgcagatggctggggcaaccggcggccaggtggatcagcgagcggttgtcccagaacaccaggtcatggggctgccattggtggcggtagatgttttccggcagcacgctgtgggcgtagagctcggcgagcaattgccggctctcgtcttccggcaggccgacgatgcgggtggtgaagccttcgctgacgaacagcgccttgcggccgttttccgggtgagtgcgcaccaccgggtgcaccacttcctggacctggtccagttgctccggggtcagggtcgggcgccagttgccctcgaacttggtctcgctgtagcgcgcggtgtaggaatgcgcggcagagcggccatcgaccgccttgcgcagcgcttctggcaggctgtcccaggctttgtgcatgtcggcgaacaaggtgtcgccgccctcggacggcagctcctgggcgtgcagcatcgagcccaggctcggcagttccttgtaggagagatcggaatgccagaacttgccggcgtcccccaggccgatggactggccgttctcgatgatgttggaaacgatgaggatttccgggtgcccggccagcaggaactgcttgagcacgtggatctgcagcacgccgaaacggcggctgaaggcgatctgttgttcgggggtgatgcgctggtcacggaataccacgacgtgatgatccagatgcgcgcggtgaatgcgcgcgaagtcctggtcgttgaccggccgggtcaggtccaggccgacgatctcggcaccgacggcgccgctgaacgggcggatatcaaaagcttgtgcggcgatgggcgcggcacttggagagggtacggacataaatcactcccacgcagagcacgcccagtggcgcgcgcgtcgatcagaaactcacggaggtcccgtgtgggttcatttcgtgcggcgcgccgattggtcggcaggtacgcagggagacgactttatagatataagaactgaattttaaataccgttaacgaataacgatatggcgattcggccgcagacctcaaggccggcacgagcgcctctagccgctgccgccaggctgcgatcggccccgaaggggacatgacgatttcaatatcgctgaaggcccttcgggccttatcgcagcctggcggcagcggctacagatggcttaacgctcgtgcagcgcctcggcgcgggcgcggatgatcggcttgagcaggtagctgagcacgcttttcttgccggtgatgatgtccaccgaggcaaccatgccggggatgatcagcaacggcttttcatcggtgcccaggtggctgcggtcggtgcgcagcttgatcacgtagtaggtggtcttcttgtcttcgtcggtgatggtgtcggcgccgatctgttccagcttggccttcaggccgccgtagatggtgtagtcataggcggtgaacttgaccaccgcttcctgccccgggtgcaggaaggcgatgtcctgcggacggatcttcgcttccaccagcagggtgtcgtccagcggcacgatctccaccatgtcgctgcccggctggatcacgccgccgatggtgttgaccatcagttgcttgacgatgccgcgcaccggcgaggtaaccagggtccggctgacccggtcttccagggccttgccggtggcgctggccttgttcagttcggtgcgtgcctcgttgagctgggtcagggcttcgctgcggaacttgccgcgggtttcgtcgatcttgcgctggacttccttgatcgccgattcggcacgggggatcgccagggtggtggcgtccagttgcccacgagtctcgacttcggcgcgcttgagccgcagcacttccaccggcgacaccgcgccctgggccaccagcggctcggacatggcgatttcctggcgttgcaggcccagttgctggcggtactgcgcctgcttggaagtgaactcgcgcagttcctgctgcttctggatcagctgttcctgcaggccgccgacttcgtcgtgcaactgctggcgacggctttcatacagcgacttttcgctggccgcctggccgggcacggcggccatggcatcggccgggaaattcagttcgcggttgtcgatctccgcgctcaggcgctcgacccgcagcagcatcgacaggcgatcggcctcggtctcgccgacgttggacttgaaacgcgtgtcgtccaggcggatcagcggggcgccggcttcgacgatctgcccttccttgacgaacagttcggagacgatgccgccttccaggttctggattttctgcaccttggacgacgggatcgccttgccctcgcccttggtcacttcgtcgatcaccgcgaagttggcccacagcagcagaaacaggaagaagccgatgatgccccagatggtcaggcggataacccgcggcgcatcctcgatcagcgccttgttgacctcgggcaggggttggtcgtgcagcgattcggtgcctttgaagtagcgcaggatcgagtctttgaaaccggatttaagcaacactgatctgccccttcttcaacgcttccatcacgactgctttcggcccgtcggcgaggatctgcccgcggtcgatcaccagcaggcgatccaccagcgacagcagcgaggcacggtgggtgaccagcaccacggtcttggcttccaccacggcttgcaggcgttgtttcaagcgttcttcaccggtgttgtccatggcgctggtcggttcgtcgagcagcaggatcggcgggttgagcaacagggcccgggccagggcgacgttctgccgctggccgccggagaggttctgcccgcgctcgccgacctgcagctcatagccctgcgggtgcaggcgggcgaattcgtggacgccggccagttcggcggcctgcagcaccagttcgtcttcgacgtaacgggcgccggaggtcaggttgtcacgcagggtaccggccagcagctggatgtcctgggccacataaccgatgttgtggcgcaattcgctgacgtcgatctgccggatgtccacgccgtccaccagcaaggcgccggagtccggggtatacaggcccaccagcagcttggccagggagctcttgcccgagccgctgcggccgatgatgccgatcttctcgcccggcttgaccaccaggttgatgttcttcagcgctgggttctgctgccccgggtaggtgaaattcagttgccggcattcgatggcgccctgcagcacgttgcggctcagggggcgctcgtcgaagttgcgctcctggggcagctccatcatctggtcgaccgaggtcatggtcacccgcgcctgctggtagcgggtcagcaggccggacaacgaggccagcgggctgagggcgcggccgctgagcatgtagcaggcgatcaacccgcccatgctcaggttgccgtcgatgatctggtacacgccgaagacaatcatgatcaccccggccagctgctggatcagcagggtgatgttcatcgccaggctggagagcatcttcacccgcagctcgagacggcccagggtgccgatggtctgttcccactggtactggcgttcgctttcggcgttgttgaccttcaccgcgtccagcccggccagggtctcgatcaggctcgactggcgctcggcgcccagggccatggttttttccatggtggcgatcagcggtttctgcagggcgtagccgatgcccagggcaatcgggaaggccagcaccggaatccacaccaggtgcccgccgaggatggcaatcaccaggaagatcagcagggtgaacggcaggtcgatcaggctggtgagggtcagcgaggcgaggaagtcgcgcaggctctggaactcgtggatgttctgggcaaagctgccgacccgcgccggccggtacttcatggccatgccgacgatgcgctcgaacagcgtggccgagatgatcaggtcggtcttcttgccggccaggtccaggcacaggctgcgcaggctcttgagaatcaggtcgaacaggtaggcgccggtgatgccgatggccagcacccacagggtggcggcggcctggttggggaccacgcggtcgtagacgttcatcacgaacagcggcgcggccatggcgatgacgttgatcagcaggctggcggcgatggcgtcggcgtacagccagcgcgaacgcttcaaggtgtcgcggaaccaggagcgggcgcgaggaatcagcgagccgtggttgacgtcgaatttgtgttggggctgggcgaagaacacttgcccgctgtagtcgtcggccagcatctgccggctgacgctgacctcgccgccgtcactctcgctgagcagcaggcgggcctggtcttcgccctgccagccgagcaggacggcgctgcggccgtccttgagcaacagcatggccggcatagcgatggcaggaatctgctccagcttgcgccgcagcaaacgcccctgcaggccggcgcgagcggcggcgcgcggcagcagctcggcgctcaggcgctgggacggcaacggcagaccggtggtcaacatcgccgcgctggccggcttctggtgcagggaacacagggttagcagggcatccagcagcgggtcgtcatgcatgccgcgtggatcatggctaagttgcactcgactgacttctgattccacgctcggcactctttaactgtctattggatgaaaagtactcaattcatcccaggcagttggaccttgggcttcacatcgttctgcacgacggaagccatgggtgcgaccactccctggctcttgagcaattcgcccatggtcgccttgattcgatattgagtaaataactgaatgttcttgatttccgccaaccgacgcgaggcggtgaacagttcattctcgctatcgagcaagtcgagcaaagtgcgctcgcccagactgaattgcttctgatacgcctcacgcacgctggcgctgcgatcgacatattgctgggcgatcggcacttgcgcattggcgttgttcaaggcgttccacgccaagcctagctcttcattcagaacacgcagggcgttgttacgaatatccagcgcctggttggactgataggccttggactccaggtcggccttgttgctgccgccggcgaacaggttgaagcgcatgcgcagcatggcctgccattcgttgttgtggccgtcgatgccgtccaggttgttgtcggcggtacgccccagctcggcatcgaagcgcgggtagaaggtcgacttggcggcttcgtactgcttctcggcggcgacgatgtcggattcggccgagcgcaggatcgggctgttttccagcatctggtgccgggcttcgtcgaggctggccggcagcagggccatgaagccgaccgggcgctccagctggtccggcatctggccgacggcgctgaggtagttggtctgggcatcggccaggttggtctgttcggtgatcaggttgttgcgcgcctgggccatgcgcgcttccgcctggtcgaggtcggcgcggctgccgacgccgcgctgggtgcgcagctggatctgatcgtagatgcgctcgtgattgcgcatgttgtcttcggccaggcgcacgaactcgcgccgggtcagcacatccaggtacacctgggccacggtcagcgcggtgcgctcggaagtgcccagcaacgagtacgcccgggaattgacggtggcttgttgacgcccgacctcactggaggtggcaaaaccgtcaaaaaccatttgctggagacgtaaacttgactcgctgcggttcagcgtctcccagtgattgctcgatcctgcacgagtggtcgggctgtcggtgccttcacgaccataaccgcccagcaaatcgacccgcggcaaatagccgcccttggccgccttgagctggtaatcggctgccaggcggctgttcaccgcggcctggatttccggatggacatccagtgctttctgcatggcttcgggcagggtttgtgcttgggcgaaactggcggcgagtacgaagggtaaggctttgaacaactgcggacgcatagaggaggttcccaggacttcttgtcccaaatcacagcaaaacgaggtgctgcatcggatgatggcaaccggaatgaccgtatatcggaaagttcaaaccatgaactgggtcacacacttttagacaggtcgccgcatgaatatcaatgtgacattaccttgacgattgtttaggatgacactcagaaggtcaatagtttggcatatggttaatagcaaaaaaatatagccaatttattgacaaatatccgcgtcaaaatcacgtgtttctacactctgaagaacgtccagactgcgtcggcgtatgcccgtcaggaacatggaagtctactgaacggtaccccccggagaatcctcaatgagcagtgttgttgctaccgtcaaaagcattgttggccaagttttcgtcgtatccccggaaggggttcgccgcgtactcgttgagggtgatcgcctgtacgtaggcgaccaggtcgataccggcctggcgggtgccgtcagcctggagctggccgatggccggaccctggacctgggccgtgagacgcaatggagcggcagcgctccggactccagcaccgacctggccgaggccgccgagcaagccgcgccgtcggtcgctgagctgcagcaggcaatcgtcgccggcgcggacccgactaccgagctggaagccaccgcggccggcccgaccgccgcgggtaccggcggcgctgcgggcggcggccacagcttcgtgatgctcgacgccacggcaggccgggtcgacccgaccatcggcttcccgaccgcaggcctcggcgcggcgagagccgcggcgcaagacaccaccggtgctctgaccaccaatgacagcagcactaccaccgagatcctgcgcgactcgaccctgagcctgagcgcaaccccgaccattaccgaagccggcggcgtgctggtgtacaccgccacgctgacccaggcgccgctgactggcctgaccatcaccctgtccaacggttcggtaatcgtgattccggccgggcaactgaccggcaccgtcaacgtgccgctggcaccgaacgacaccgtctacaacgacccgaaagagatcagcgtgggcgtcaccggcaccagcggcggcggtggcctggccgtgaccgtcgacccgacgccagccgtcacccaggtcacggacaccgtggacaccaccaccgtgaccctgaccgcgggctccagcgtgaccgagggtggccagatcacctacaccgcgaccctgaccaacccggcgcagaccccggtcaccgtgaccctgtccaatggctcgaccatcaccatcgacgccggccagaccgtcggcaccgtggtggtcgacaccccgccgaacgacgtctacaacaatggcagcaccgtcagcaccagcattaccgggactaccggcggcaacttcgagaatctggtaccgaacccgacgccggcggtgactaccatcaccgactcgccggacactaccggcctgaccctgaccgccaacggcaccgtcgtcgaaggcggccagatcacctacaccgcaaccctgaccaacccggcgcagacgccggtcaccgtgaccctgtccaacggctcgatcatcaccatcgaagccggccggaccgtcggcaccgtggtggtcgataccccggccaacgacgtctacaacaacggcagcacggtcagcaccagcattaccggcaccactggcggcaacttcgagaacctggtgccaagcaccacgccggcggtgaccaccatcaccgactcaccggatgccaccggcctgaccctgtcggccaccggcaccgtcgtcgaaggtggccagatcacctacaccgcgaccctgaccaacccggcgcagaccccggtcaccgtgaccttgtccaatggctcgaccatcaccatcgacgccggtaaaaccactggcaccgtggtggtcgataccccggccaacgacgtctacaacaacggcagtacggtcagcaccagcattaccggcgccaccggcggcaacttcgagaacctggtgccgagcaccacgccggcacagaccaccatcgccgactcggtggacaacaccggcctgagcctgaccgctaccggcagcgttgtggaaggcggccagatcacctacaccgcgaccctgaccaacccggcgcagaccccggttaccgtgaccctgtccaacggctcgaccatcgtcatcgaggccggcaagaccgtcggcaccgtcgtggtcgatacccccgccaatgacgtctacaacaacggcagcacggtcagcaccagcattaccggcgccaccggtggcaacttcgaacaactgacgcccgacaccacgccggcgcagaccaccatcaccgactccgtggacgacaccggactgagcctgtcggccagtggttcggtcgccgaaggcggctcgattgtctacaccgccaccctgaccaacccggccggcacgccggtcaccgtgaccttgagcaacggcgcagtgatcaccatcgccgccggcgcgaccacaggttccgtgagcgttgccgcgcccgccgatgacgtctacaaggacgccggcaaggtcgaagcgaccatcaaggacgccactggtggcaactttgaaaacctggtgccaagcaccacgccggcggtgacggacatcaccgacaccatcgacacctcaactgtttcgctgaccgcgacgccgtccgtggctgaaggcggcactgtggtctacaccgcgtcggtgaccgcgccagtgactggttcgccagtggttgtcacgctgtcgaatggccagaccattaccattccggtcggcgagtcctccggcaccgtcaatatcacggcacctaacgatgccctcgccggcggcagctccctgagcgccaccatcaccggtgcaacaggcggtaactacgagaagctggacgttgacggcaagcctgccgagacctcggtgaccgacaccccggacaccaccaatctgagcctcagcgcgaccgacaccgtggccgagggtggttcgattgtttacaccgctaccctgactaacgctgccggtactccggtgaccgtaaccctgtcgaacggcgcggtgattactatcgctgccggcaccactactggttccgtgaccgtcgcagcgcctgctgacgatgtgtacaaggatgctggcaaagtcgaagtcagcatccaagagactgctggcggtaatttcgagaacctggttccgagcactaccccggccgtgactgatgtcactgacaccatcgatacgtcgaccgtcagcctgaccgcgacgcctagcgttgctgaaggtggcgttgtcgtttacaccgcttccgtaacggctccagtgaccggctcgccagtagtcgtcaccctgtccaacggacaaaccatcaccatcccggtcggcgaatcttccggcactgtgaacttcacggcgccaaacgatgccctggccggcggtagctccctgagcaccaccattaccggtgcaaccggtggcaactatgaaaaactggatgttgataacaagccggctgatacctcggttaccgataccccagacaccactagcctgaccttgagcgccacagacaccgtggccgaaggcggttcgatcgtttacaccgcaaccctgaccaatgctgcgggcacgcctgtgaccgtgaccctgtcgaacggcgcgatcatcaccattgcagcaggcgccactactggttctgtcactgtcgccgcccctgcggatgacgtttacaaagacgctggcaaagtcgaagtcagcatcaaggatgctgcaggcggtaacttcgagaacctggttccgagcactgccccagccgttaccgacgtcaccgatactatcgacaccagtaccgtttcgctgactgctactccgtccgtggcagaaggcggcaccgtggtttataccgcctccgtgacagcaccagtgactggctcgcctgtagtcgtgaccctgtcgaatggccaaaccatcaccatcccggtgggtgagtcttccggcaccgtgaacttcacggcgccaaacgatgcattggctggcggtagctccttgagcaccaccattaccggcgcaacgggcggtaactacgaaaaactcgatgtcgacagcaagcctgccgagacctcggttactgacactccggacaccaccaccctcagcctgacagcgactgacactgtcgcggaaggcggttcgatcgtttacaccgcaaccctgaccaatgcggccggcacgccggtaaccgtgaccttgtcgaacggtgccgtaatcaatattgccgccggtgccaccaccggttctgtcaccgtcgcggcccctgcggacgatgtgtacaaggacgccggcaaggttgaggtgagcattaaggacgctatcggcggcaacttcgaaaacctggtgccgagcaccacgcctgccgtcaccgatgtgaccgataccatcgatacgtcgactgtcagcctgaccgcaaccgcgactgtcgccgaaggcgaaaccgtggtctacaccgcgtcggttactgctccagtgaccggctcgccagtggttgtaacgctgtcgaacggccagaccattaccatcccggtcggcgaaagcagcgggtcggtgaacttcgttgccccgaacagcccgctggcgggcggcagctccctgagcaccaccatcacaagcgctaccggcggcaactacgaaaaactggatgtcgacagcaagcctgccgacacttcggtcactgatactccggataccactaccctcagcctgactgcgaccgataccgtggctgagggtgggtccattgtttacaccgcgaccctcaccaatgccgccggcactccggtaaccgtgactctgagcaatggcgcgatcatcaccatcgcagcgggtgcgaccacaggctccatcaccgtcgcggctccagctgatgatgtgtacaaggacgccggcaaggtcgaagtcagcatcaaagacgccgtaggcggtaacttcgagaacctggttccgagcatcacacctgctgtgactgatgtcaccgataccatcgatacttcgactgtttcgctgaccgctactccgtctgtagctgaaggcggtgttgttgtttacaccgcatccgtgactgcgccggttactggttcgccagttgtggtaactctgtccaatggccagaccatcaccattccggtgggcgagtcgtccggtaccgtgaacttcaccgcaccaaacgatgccctggcgggcggtagctccctgagcaccaccatcaccggcgcaacgggcggcaactacgagaagctggatgttgatagcaagccagcggagacctcggttaccgataccccggacaccaccaatctgagcctcagcgcgaccgacaccgtggccgagggtggttcgattgtttacaccgctaccctgaccaacgccgctggcacgccggtgactgtaacgctctccaacggcgcagtgattaccatcgccgccggcgctacgactggctccgtgaccgtggccgccccagccgatgacgtgtacaaggacgctggcaaggttgaagtcaccatcaaggacgccgctggcggtaatttcgagaatctggtgccaagcactactccggctgtgactgacgtcaccgacaccatcgatacctcgaccgtcagcctgaccgccactcctagcgtcgccgaaggcggcaccgtggtttacaccgcgtcggtcaccgctccagtaaccggctccccggtagtcgtcactctgtccaacggtcagaccatcaccattccggtgggcgagtcttccggcaccgtgaatttcaccgcgccgaacgatgccctggcgggcggtagctccctgagcactaccatcaccgacgcgactggcggtaactacgaaaaactcgatgtcgacagcaaacctgccgagacttcggttaccgatactccggataccaccaccctcagcctggctgcgaccgataccgtggcagaaggcggctcgattgtttacaccgccaccctgaccaacgctgcgggcacgcctgtgaccgtgactctgagcaatggcgcggtgatcaccatcgccgccggcgccaccagcggcagcgtgaccgtggccgcgccgagtgacgacgtctacaaagatgccggtaccgtagaagccacaatcaagacggctactggcggcaacttcgagaacctggtgccgagcactacgccggctgtgaccagcgtcaccgacactatcgatacttcgactgtgtcgctgaccgctactccatctgtggcagaaggcggcaccgtggtttataccgcctccgtgaccgctccagtgaccggttcgccggtggtggtaaccctgtcgaacggccagaccatcaccatcccgattggcgagtcttccggcaccgtgaacttcaccgcgccgaacgacgccctggcgggtggcggctccctgagcaccaccattaccggcgcaaccggtggcaactacgagaagctggatgttgatagcaagccggctgatacctcggttactgatactccggacactaccaacctgaccctcagcgccaccaacaccgtggccgagggtggctcgatcatttacaccgccaccctgaccaacgccgcgggcacgcctgtgaccgtgacgctgtcgaacggcgcagtgattaccatcgcagcgggcgccaccacgggcaccgtgaccgtggccgctccagccgatgacgtgtacaaggacgccggcaaggtcgaagcgaccatccagaccgccaccggcggcaatttcgaaaacctggtaccgagtactgcaccggcggtgaccaatgtcaccgacaccatcgacaccagcaccgtttccctgacggccacgccgtccgtggccgaaggtggcgtcgtggtctacaccgcatcggtcaccgctccagtgactggttctccggtcgtggtaaccctgtcgaacggccagaccatcaccatcccggtgggcgagtcgtccggcaccgtaaacttcactgcgccaaacgacgcactggtcggcggcagctccctgagcaccgccatcactggcgcaacgggtggcaactacgaaaaactcgatgtcgatagcaagcctgctgacacctcggttaccgataccccggacaccaccaacctgaccctcagcgccaccaacaccgtggccgagggcggctcgatcgtctacaccgcgaccctgaccaatgccgcgggcactccggtgaccgtgaccctgagcaacggcgcggtgatcaacatcgccgccggcgccaccagcggcagcgtgaccgtggccgctcctgccgatgacgtctacaaagacgcaggcactgtgcaagccacgatccagaccgccaccggcggcaacttcgagaatctggtgccgagcgctgcaccggctgtgaccaacgtcaccgataccatcgacacctcgaccgtcagcctgaccgcgacctcgaatgtggccgaaggcggtaccgtggtttacacagcatcggtcaccgctccagtaaccggttcgccggtcgtggtcactctgtccaatggccagaccattaccatcccggtcggcgccagcagcggtaccgtgaacttcaccgcaccaaacgatgccctggctggcggcagctccctgagcaccactatcaccaacgccactggtggcaactacgaaaaactggcagtcgacagcaatccggccaacaccacagtcaccgatactccggacaccaccaatctgaccctcagcgccaccaacaccgtggccgagggtggctcgatcgtctacaccgcgaccctgaccaacgccgccggcacacctgtgaccgtgactctgagcaatggcgcggtaatcaccatcgccgccggcgccaccactggcactgtgaccgtggccgctcctgccgatgacgtctacaaagacgccggtaccgtgcaagccacgatccagaccgccaccggcggcaacttcgaaaatctggtgccgagcactgcaccggctgtgactaacgttaccgataccatcgacacttcgaccgtcagcctgaccgcgacctcgaatgtggccgaaggcggtaccgtggtttacacagcatcggtcaccgctccagtaaccggttcgccggtcgtggtcactctgtccaatggccagaccattaccatcccggtcggcgccagcagcggtaccgtgaacttcaccgcaccaaacgatgccctggctggcggcagctccctgagcaccactatcaccaacgccactggtggcaactacgaaaaactggcagtcgacagcaatccggccaacaccacagtcaccgatactccggacaccaccaatctgaccctcagcgccaccaacaccgtggccgagggtggctcgatcgtctacaccgcgaccctgaccaatgccgcgggcactccggtgaccgtgaccctgagcaacggcgcggtgatcaacatcgccgccggcgccaccagcggcagcgtgaccgtggccgcgccgagcgacgacgtctacaaagacgcaggcactgtgcaagccacgatccagaccgccaccggcggcaacttcgagaatctggtgccgagcgctgcaccggctgtgaccaacgtcaccgataccatcgacacctcgaccgtcagcctcaccgcgacctcgaacgtggccgaaggtggcaccgtggtttacaccgcgtcggtcacagctccagtaaccggttcgccggtcgtggtcactctgtccaatggccagaccatcaccattccggtcggtgccagcagcggtaccgtaaacttcgtggcgccgaacgatgtcctggttggccacacgccactgagcaactcgatcagcaccgtcagcggcggcaacttcgagaacctggtggccgacaagacgccggtcagcaccaccgtgaccgacactccggacaccaccaacctgtcgctcagcgccaccagcaccgtggccgaaggcggttcgatcgtctacaccgcgaccctgaccaacgccaccggcacggccatgaccgtgaccctgagcaacggcgcggtgatcaacatcgccgccggcgccaccagcggcagcgtgaccgtggccgcgccgagcgacgatgtgtacatcgacgccggcaacgtcagcgccagtatcgccagcaccaccggcggcaacttcgagaacctggtgcccagcactacgccggccgtgaccagcgtcaccgacaccatcaacaccaccacggcgagcatcaacggcagcacctcggtcaccgaaggccaggccgcgacctacaccgtcagcctgaccagcccggcgcaaaccgaggtcaccctgaagatcagctacagcggcaccgccaccgacggctcggacttcaccggcgtatacaccgtgaagatcccggccggcgccagcagcgccagcttcaacgtcgccaccctcgacgacaagatcaccgagggcacggaaaacttcgtggtcaagatcgactcggccagcggcggcaacttcgagaacctggtggtcagcggcaccaacggcagctcaccacttcgatcatcgacaacgatgcgccaccggtcctcgacctggatgccaacaactccagcggcgccaccggggccgactacaaggtgaccttcaccgaaggcaccagcggcccaggcgtgtccattggcgataccgacctgtcgatcaccgacccggacagcacgatgctgaccggcgccaccatcgtgctgaccaaccgtcagccgggcgactcgctgaacctgggcaccagcgtcaacggcatcagcatcaatgccaacagccaggcgggcaccatcaccctgaccctgtccggcaatgcgacgctggccgactacatgcagcagatcaagaacatcaccttcaccaacaacagtgaggacccgagcaccacgccgcggaccatcaccgtgacggtgaccgatggcagcaactactccaacgtcgccaccaccacggtcaacgtggtggcggtgaacgacgcgccagtggccaccggcggcgccgtgaccggcaccgaagacaccgccctgaccctgacctgggccaccttcggcgtcagcgacgtggacagccctgcggccagcctcggggtgaaaatcacccagctgccgggcgacggcaagctgcaatacctcgacggctcgacctggaaggacgtggccagcaaccagaccttcagcaaggccgatatcgacgccggcaagctgcgcttcaccccggatgccaacgagtcgggtgtcgacggctacaacggcagcggcgtgggcaaccagcaggccgactacgcgcagatcaagttccagccaaccgacggccaggccctgggtaccaccggcaccgtgaagatcgacatcaccccggtggccgatgcgccgaccctgggcgtggcgagcaacagcgtgaactccatcggcctgctcaaggagtcctggagcagcctcagcggcctgggcaccaacggcagcggcatcaccggcgatgcgctgaaaaacgtcttcaacaactccggcaacccgaccagcagcacgacggtgaccaatgcccagtccgatgccagcgtgaccggcggcagcggctcgaagacctccggcctgatctacctcgaagccggcaagacctacagcttcagcggtgtcggcgacgacagcctgctgatcaccatcggcggcaagaacgtggccaccgcgacctggggggccggtggcagcatcagcggttcgttcaccccgaccaccagcggctactacaccctggacatctaccacgccaaccagagcggcccgggcagctatgacgtcaacctgtcggtcaatggcagcacaccggtcgacctgagcaacgccaacatcccgatgtacccgagcgaaaccgcgctgaacaatgccggcgtcaccctttccgagctgcacggcagcaacggcgagggctactacgacggctacaagctcaacgagggtgccgaaggtgacagcgtcaagctgtcgaagatcaccaccgccctgaccgataccgacggctcggaaagccttagcgtgaagatcggcggcattccggccggctcggtactcagcgatggcgccggtcataccttcaccgcgggcggcagcgtcagcgaagtcaatgtcaccggctggaacctgggtaccctgaccctgaccccgccgtcgcactacaacggctcgttcaacctgaccgtgacctcgacctccaccgagtccctgggcggctcggccagcagcaccgcgcagatcccggtcacggtgtacccggcgacctacagcgccagcgtcgccacggcgggcgacgacaacttcgtcggcaccgagggcaacgacatcatggtcgccgacgtcgccggcctgaacgtggtgcaaggcaagaactacaacatcgcgttcatggtcgacagctccggcagcatgagcgacgcctcgctcaccgccgccaagaactcactgaccacggtgttcaacaccctgaaaaacagcctgggcagcagcacctcgggcaccgtgaacgtcttcctggcggacttcgatacccaggtcaacaagcaggtttcggtgaacctcaacgatccgaacgccctgacccagctcaaggcgattctggacagcatggcgtccggcggcggcaccaactacgaggacgtattcaagaccacggccaacttcttccagagcagcgcggccaccagcaataccaacgccaccaacctgacgtacttcatcaccgacggcaaaccgacgtactaccagtccggcgagcagaccaacccgatcctgtacggcagcgtcaggctcgataacgtgatcacgaccagcaactatcagctgggcgataccgtccggctgcaaccggacagcacgcacctgatcgatatcaatagcagcggcagcgttacggtatggacgcaggcctggggcagctggtccagttacaacgctggcaccctgcatgcccagggcgatggcacttacgagctgtccagcctggccggcgcgggcagctataccaacaacgccaccaccaccaactccagcagcagcttcaccctgctgagcaacctgtcgcaggtggaagcgatcggcctgaacaacgatgtcagcctcaacgacctgcggccgtacgacaccgacagcaccccacagaccaatatcgacccgtcgaacctggccgacgctatcctcggccataccgaagcgaccatgccgggagccgacacggtcaacggcggcaacggcaacgacatcatcttcggcgacctggtgagcttcaacggcatcgccggcgagggctaccaggccatgcaggccttcgtggcgcagaagaccggcgtggccgcgagcagcgtcaccaccagcaacgtgcaccagtacatcaccgagcactacaccgacttcgatgtctccggggcccatgacggcaatgacacgctgctgggcggcgccggcaacgacatcatcttcggccagggcggcaacgacctgctcgacggtggcaagggcaacgacatcctgttgggcggtaccggcaacgacacgctgatcggtggcgcgggcaatgacatcctgatcggcggctcgggtgccgacaccttcgtctggaaggccggcgacaccggcaacgatgtgatcaaggacttcaaggccagcgaaggcgaccgtatcgacctgcgggacctgttgcagggcgagagcgccagcaccatcgacaacttcctgaagatcaccacggtggacggtacctcgaccctgcaggtcagttccgaaggcaagctcaacgcggccggcggcattgccaacgcggacgtgacgatcaagctggagggcaacaactggtccaacaccaacatcagctcactgatcgccggtagcgacccgaccatcaagatcgatcacaacaacagctgatccacggtcgaccggccacccgtcctgggtggccggttcttcccaccgtgacgattgtgccgccacatcgcatactcgcgaccaaagcgcgccgttggcctatgctgctgacagcatgatgccggaccatatcgagagggattcaccatgttctacgtgcaacgcgatgcacagggccaactggttcgcgtggagcccacaccttacgccgaggccacggaaacactgccggccgaccacaatgagatccagcagtggttcgccaacgaggtggtggaagtcagcctgaaacaactcaagcagagcgacctggaaatgatccgggtactcgacgacttgattcaggtgctgaccagcaagggtgtgatccgcgtcaccgacctgccaccggcggcccaggccaagctgatggaccggacccaggcgcgtgaggcgctgggtggcctgagccacctgatcaacgacgacgaaaccggcctgatctgataatcgccggccagcggttcccgcacctgcgcgggcgccgctggccggcgatcttcgttcagcgcctcagcgccagggcgcgggctcgccgaacaggcggccctggacgccgtacaggcccatctcgcgaatcacctgcaactccccttcggtttccacgcgctcggcaatcagcggcaggtcgatgctgtgggcggcgcgctggatggcttcgataaacaggcgcttgtcgctttcctggtcgatgtcgcggatgtagctgccgtcgatcttcaggtaggccaggcccaggcgcgccaggttgccgatcatgctgaagcgcccgccgaaacgctgcaggctcagggagaaacccagctcgcgcaggcggcgggtcagttgttccagcagcgcttgttcaggcaactgctcttcgccgatctccagggtcaggcgcggccccaggttggagtgctggcgcaggatctcgaacaccttgttcaaggcctgcgggtcggccagggtcgcggccgacaggttcaatgccagcgaatcctgatgcccggccatctgcttgagcacctgttcgagcatcagcaggtccaggcgcgaggtccagccaaagcgctccagccacggcaggaagcgcccggcggcaatggtctggccctgctcgtcgagcaagcgcgacagcaccttgtagtgcagcaccagcgtggtatcgcgggtcgcgaccaccggctggaaatacagctcgaaccgctgctggctcaaggccccgtccagcagggtgtgccaggcgtgatgatcgtcgccgacgctggtcgccgcgtcgtggtccaggcaggcccagctcgtatcgccctgggcctcggcctgggccagggcctggtcgcccaggctcagcaccgcctgcggcgagtcgccatggacgaagggcgccaggccgatggaggccacggacgccacgtcggtagcgccggtggcgtgcaggctggccaaggcgttttccaggttctgcgccagctgcagcgcctcttcgcgcaccagccccggcgccagcacggcgaattcgccaccgcggatgcgggtcaccaggttgtgggtttccgggtagcgcgcgcattcacgctgcaattgctcgcccaccgcctgcagcagctggtcggtgcgctgcccgcccaggcgctggttcaggccggccaggtccttgacccgcagcaacagcaggtagccggagctggcctgctccgggttgctcacccgggcattgagctgcatctcgaagtaacgacggttggccaggccggtcaggttgtcctgataagactcgacccgcagcctttcgctgcgctcggcctgttcctggaacagcgccttgagcttctcgaccatctggttcatcgcctgcaccacgcggcgcagttccggcgtgcgcggcagctcgggcaggctgaggaattcgcggcgggcaatggcgtgggattgctgcaccatgtagtccagcggcttgagctggcggcgcaacagcaaggcccccagcaccgcgctcacggcaccgcacagcagcagccagccgaggctgcccagggcgctttgccagagcttggcgacggcgaacatcggatggctgaccacctcgacccgcgccgcctgttgccagccacggctgaccagggcgtcgccgccgaccggctccaggccgatcagcttgacgaaccagtccggcacgtcactgacctcgggcgtgccgctgcgctcgaccatgacctcttcggtgacctggttgatcacgcggatgctcgagtagtagccgctgtcgaaaatcgagctgaccagcagctcgaccatggccgggtcgtcgatgttcggggtcagggacaaggccagcgccgtggccgcgtcctgggcatgggaacgcagctggttgacgtactgggtgcgcgaactttccaggctgaccatgaagctgccgctgaaggcgaccaccaggaacagacagattgcgatcaacagttgtttgaacaaagacatctgagctcgtgctcctagtgagtcgtctcgaccggaaaaccttcggcctgcattttcttcaacacgtcctgccaccgggacaggcgcttggtgtcaccgactttcttgctgcccttgccgggcagccacaggccctcggcattgaaggcgtacaccggcagcaggtcggtacgctggctggccggctggatggcgtcgatcaggctgtcgaggaccaacggcatggcctccggacttgaatagtaggtcaacaccatgtgcgcgcggttctggcgcaaggccttgacgtaggtgatgcgcagcttgtcactggaaacaccgaggtggcgcaggctgaaatacttggcgatcgcatagtcctcgcaatcgccggcgcccttccacagggcctcgaccggggtttcccaataatccacctgatgccacaggtcgatgtcttccacgtagcgcatgttcttgttgaagaacaggttgaccaccttgagctgttccatctcgctggcctggttctgggtcaccagcagctgctgccaggcgtcgatgcgcttctgcccttcacccagcggcccgtacagcgccgtggcgcggcggctgatctgcgaaaagtcccaatcggcctgcaggccacccagcagcaagccggccagcagcagcgccgaaaacagccagcgcagggtccgagaaagagctaaacgtgccgccaatgcgaagagtccatgggagctgtcgtgggtcgaaggatggtgcaggttggtccgccaaaagacaatggcaccttacaatcacagcccctctggagacgctaagctgaaagcagggacctgttcgtttatcggccagtgcttgagcctcaggagggctgccccgagaatcagcgccggcaaaatccatgacagggcccagacggctggtttgacaagctgcagggcgctatctagcgtccattggatccaaacctcagaaaacaggatagcgttaacgtgacagaaaaaccgaggcccttgagcaagatcgcagtcagcgggccaatccccgcccacctcgcgcgctcggtgatcgaggaaaccctgcgcgcggcgattctcgacggccgcctgcccagcggcacggcgctgcgccagcaggatctggccgacctcttcggcgtcagccgcatgccggtgcgcgaggccttgcgccagctcgaaacgcaatcgctgttgcatgtggtaccgcacaaaggcgcggtggtcgccgaactgatcggctatgacgcggtggaaacctacggcctgcgcctgctgctggaactggaggcgctgcgcctgtcgatcccgctgctcgacgccgaggatatcgcccaggcccgcggctacatcgcgcagctggaaagcgaaaccgaccacgccgaaatcggccgtctcaaccgtttgttccacatggcgctgtaccaccgggcgccgaaccagaagctactgcgcctgatcgagctcgagttgaacgaggaagaacgcttcctgcgcttccatctgtcctccatgggcctgggcaagttgacccaggacgaccacaacgccatgaccgacgccgccgaggccaaggacgtcgagcgggcggtggaggtgctgcgcggccatctggaaaaggccgcgaagaccattcgcgactacctcgaacggaccgccgagggctgacagcggtaacggcggcatgacgcggccacgatgcaacactcaatgaccggcacaccggcttaaggaaaagcagtgcacgcgcgcaatgacaaatggctgatagtgctcaactccggcgagccggcgaaaacccggctcatctgctttgcgcagaccggcgcggacccggaacaactgcgcaactggtccaccgggctgggcggacacatcgagttggtgctggtgcggctgcccggccacggcagtcgccaggccgaacccccgctcgacgcctggccgcggctgctggccgataccttctccgccctgcgcccattgttggccaagccccacgccctgttcggccatggcctgggcgggatgctggcctacgaaaccaccaagcacgcccaggcgcactaccccggccagacccgccacctgttcatttccgcctgccgcagccccgactacccatcgccccggccgttgctgcacatgttgcccgcggcgcccttccaggaagccatgctgtcgctgggcgccacaccgatcgaaatcctccgcgaccaagccagccggaagcagtacgaaacgctgctgcgcgccgacctgaagctgttcgaatcctggcgcgatctgtcgagcggcaacctcgatattcccctcaccgccttctatggcagcgaggacccgctggcccccgccagcaacatggccaactggcgcgagttcacccgccgtgagttcgagctgatcgaggtggccggcaatcacttcttcatcaagtcccagcgccagcgcctgctgcagatcatcaatatccacctgggcctgctcggcgaataatccgccgtcttcctcccccgctcctgccctcacaggcccgccgacgatggctcagccggcgatttgggcccactcttgctgtcgccgactgaaaaagggacgtgagcggcgcgcaggcttgtccgcacacgtcgatctgcagacccacgcaaggagcccagcgactggagggcatgaccgggatcggctcccgcatgccttctcccagatattcaacgacttcaactcagcgcttcgaagtttgcttcgagtgaggcattcactcagcgttaaaaattctgacttatataagtcggaaggggcaacttcatctcaacaaaacttcaaccagaagttttgcagcaacttgtcgcgcgacaaaaatacaagttagaaaagtattataaaaacaacttgctcgacactttctcctgtattagttttttctccgccgacattaaacaacgtcgagcagccgttcatgagcacctggaaagcctcggctttattggttctcgcaagcccataacgccaagacgacggttctttaacggatagacaggccagcactataaaactttccagtttatcaactcaggtttgaggcccctgttcgcccgcaataaataattactgattaaaacgcctatacgagccgcaactaatcggccaatcaaacacatttgaacatctcagacaggtagcctaaatgaacgccagcaaagaacttctcgacgcccgcaaggccacactcagcgcccatcccatttttgccgaaatcaacacactcgcggttcttcaacgcttcatgcaggcccatgttttcgccgtgtgggacttcatgtcgctgaccaagcgcctgcaacaggaactgacctgcgtgcgcctgccctggctaccgccgcgggaccctcgcgccgctcggctgatcaacgagatcgtgctcggcgaagagtccgacgatcgccccgggcaaggccattacagccatttcgagctgtacctggacgccatgcgcgaagtcggcgccaccaccggggtcgtggaacgcttcgtcgcgctgcaacaggagggtgtgagtttcgacaccgccctgcacagcgtcgacgccgacccggccgccagcgcctttgtccgccagaccgtgcacaccgccgtgcaggcgccggcccattgcgtggcggcggcctttctccatggccgggaaagcgtcatcccgcggatgttccagcgcatcctcgacgactggggcatcggcatcgagcaggcgccgacctttcgctactacctgcaacgccatatcgaagtcgactccgacgaccacggcccggccgcggaacagctgctgcagcggctggtggctggcgacccgcaacgccagcaggaggtgtacgcggccgccatcgccgcggtggacagccgcatcgctctgtgggatgggctgcgcctgagcatggccgaatcggcgatcggggtgagcgcatgaacgccctcgactaccaatccttcgccgacacctgggaagagcgcgcgaccatccgcacccggccacggcgcatgctcgaggacgatgacaagctgatctatcccctgagccgccagcccctggtgcacagccagggcttcctcgaccactgtgcccatctacgggacttcgtgctggtgcaaagcctctacaagttcatcaacgacgtggtgatcttcgagaccgagctggtggacaagaccgcccgcaacatcgccaagaatcgcttcgccattgccttcccctttgcctgtcgctacgacgccatgaccgtggtggtggacgaggactaccacgcgctggtggcgatggacttcatgcagcagaccatcgccatgagcggcatcgagcccatcgagctgccccgggaaatcgaactcagccgggccatccccgccgccctgcggctggcgcccgaccacctgcgcgacgcgatggagctggtctgcgtggccatcgccgaaaacaccgtgaccaacgatgtcgccgccttcgccaaggacgacacggtcaagcagtcgatcaagggcctgatggccgaccatctgcaggacgaaggccggcattcgggcttctggtcgcggctggtgcgcatctattggcacggcgccagcgatgccgaccgcgcagagatcgcccgggtgctgccggtgttcatcgcccagtacctgaccaacgacattcagaaggacttcgacttgcggctgatcgagcaactgcccgtcgccgccccgatcaagcaggcgctgcgcgaggaagccgccgccctggcctacccgatcaaccgccatcacccgctgatcgccaacatcctgcgcttcttgcgcagcagttcgatgctggattcggcctgcgtccaggacgcactggccgactacctgccctaacggagggacccgagcatgagacgcctcgacattgtgttgacgggccgcagccaggccctgaacgaactggccatggagctggagcgccacggccatctggtgcgaaaactggactcgccgcaagccatcgccaacgccgaggggctgcggccccatctgctgatcgacgacggcagcctgagtgattcaccgcgcctcgcggcggacaccgcgcgcctggaattgcgcatcgccctgatcgcccaagcggcgcccgggctgccgcaggtgcgcctgttccaccgccacgacgctcggctgatcgaacaggcgagcctgccgccggaagctggcggcaatggccaggccctacgcggcagcacagtggccaggctggtcgccagcaccgcgcggctggtcagcggcttttcccgtggcgcggcatttttccagcagctcgcggccctggatgaacccagcgaaccgttgctgggcctggagcgcctggactcgctggccttcgagcaccggcacaacccacagccgacaccggccttgctgcgcgagatgcaggtgccgatcgtccagcgcctcgaccagagcctgctggccttcgcccagcgtccggccttgaacatccagggcgtcgactacagctaccagaccctgcatcggctgagccgcaacctgcagcggcagatgctgcgacacctgcctccagcctctgcccaaccaccgatgatcggcctgtgcctgcccaagtcggcggtgctctatgccgcgattctcgcgaccttcggctgtggcgcggtgtacttgcccctggacccggagcacccggcgcaacggcggcgctacattctcgacaacgccggcgccgccctgctgctgcacgacggctgcgaagacctggccgacctcgagctggcgcaactcgatgtgcgcaccctgttgcacgacgccgccgaggactgccttccgctgctgcgccaggcgccgccaccagaggcgccctgcgtggcgatctacacctcgggcaccaccggccagcccaaaggcgtgttgctcagccagggcaatctcagtcacttctgcgcctggtacatcgaccatgtcgagctggacccagacagccgggtgctgcagttctccaccatcaacttcgacgcctcgctactggatatcctgcccaccttcctctgcggcgcgctgctggtggtccccgaccaggaccagcggcgcgacccgcggcaactgctggccctgctccagcagcagaaggtcagccatgccttcctgccgccggcgctgctgagcatcctgcccctggagcagccgctgggcatgcggcatctggtgaccggcggcgacgtctgcgaacccttcgtcatccagcgcctggccgaccagtgcgcgctgcacaacatctacggcccgaccgaaaccacggtgctggccaccacccgccgcctgcgcgtcgacgacaacccgcgcaacctcggcctgccgatcgccaacagccaggtgctgatcctcgacgagcagctgcaaccgctgcccgaccgtacccccggcgagctgtacctggccgggcccggtgtcggcctcggctacctgaacaacccggcgctgagcgccgaacgctacctgaccctggacctgccggacgggcgccgactgcgggtctatcgcacgggggacatcggccagtggaccgacaacggcatcgagatctgcgggcggcgggacaaccaggtgaagatccgcgggttccgggtcgaacccgaggagatcgaacactgcctgcgcgacggccagctgttccgccaggtggcggtggtgatcgacgagcagcggcggatcctcgcctacctggcccagccgaacgccgccggcgacgcgctgcaaaccctgcgcgagcaggtacgccagcgcttgccggactacatgcggcccagtgcctacatcgagctgccgagcatgccctgcaccgccaacggcaaggtcgaccgccgcgccctgctggccctgccgcgtacatccggcagcaaccgccagcgacgcctgccgcagaacgccactgaacggcgcctgctggaattgtgggccgagctgctggaactgccggccgaggacatcggcaccgatgacagcttcttcaacctcggcggccactcgattttgctgtcgcgcctgctgctggcgattcgcgaagagttcggccgcggcctgtcgatcaaccgctttatcgaggcgccgaccctgagcaacctggcgaccctggtcgacggcgccgcccacgacggcccggacgcgtccctcgatcaggtgttcgccgatgccaacgccgaactcgacctgcaagtgctgccggccagccaactgggcgacgtgcgcaaggtgctggtcaccggcgccaacagtttcctcggcgtgcacatcgtccaggcgctgctggaatggggcgctagcgaggtggcgtgcctggtgcgggaaacgcccacgcaatcggccgccgcacgtttcacccaggccctgcgcgacaaccgcctggagcatctggacctgagtcgggtgcgggtgcatgccgccgatatcagccagccacggctggggctggcggcggatgtgtatgaacgcatcgaccgcgaatacggcgcgctggtgcacaacgccgccaacgtcaatcacgtgctcgattacccggcgctggcgcgcgacaacgtcgagccgctgttcgagtgtctgcgcctgtgcgaagggcgcagcaagaaggtcttcaacttcgtctcgaccctgtccgcctccagcagcatcgacgcccagggccgggtgctcgaacagccgcccgcggccacgccgccgatctacatccgcaacggctacaacctgtccaagtgggtcggcgagcggatcctgcaacgggcccgcgaacagggggtgtgggtcaatctctatcgcccgggcaacatcagtttcaacagtcagaccggggtctgccagccccaccgcaaccgcctgatgctgatgctcaagggctcgctgcaactgggccaggtgccacagctggcgatgaacttcgacctgatgccggtggacttcctcgcccgcttcatcgccttccacgccagccgttatcagccggcccacgcggtgttcaacctgcacaacccgcagcccttgagctgggaggcctatgtcgcctcgttccgcgaggccgggcgcgagttccgcatggtcagcgtcgccgactggcagcgccagctgggccgggtcgaccgcgacaacgcgctgttcggcgtcctcggcttctacctcaacggcttcgaggaagacatcggcgacatctcgctgatcggccacgccaacgccgaggccggggtgcggcgcatgggcgccgactacccgcccaaggacccggcgctgctgcgcaagggctgccagtacctgaaagacatccgttttatctgaacccacccacgctggagaacaccatgaaaaacctgcaacccgacaccctgatcaagaacccgaacgcctgccaggtcctgtccaccgtggacatcggcgccgatgcccaaagcgtctggaatatcgtcggcaacttcgccggcttcccggccttcattcccgcgttgtcgcacatcgaaatgaccggcgagggcgtgcgctcggtgcgcaagaagttcttccacgacggcaacatcgtgatcgagcaactcaactctcgggacgaccaggccctgtacatgacctggagcctgatctacgacaccctgggcattggcaatctgtgggcggccatgagcgtcgaggccttgcccggcgaacgggcgcgcgccacctggcgcatcgtcgccgacccggccgaaggcggtgccgaggtcgcggccttccagggattcctgcaagggtttgccgatgaggcaatgggcaatgtgcaaaggatgttcgagtaacactggaaatgcccctatagccgctgccgcaggctgcgatcgacgccgaaggcggcgcaagatttggggatcgctggaaggcctgcggccttttcgcagcctgcggcagcggctacaggggttcggagaccggtagagagggaggcggtccgaagtacggcaaggggtgccgatgggctgtcggacaggtaaaaaaaacgcgatgagccataccggcctcatcgcgtttttcagggcagtgcgggtcagatcttgaagctgtccaccagttgcttcaggcggttggcctgcagcgacagggcgtcgcaatccttcagggtttcgttgaggttggccacgccctgctggttcagcaggttgatctggctgatgtcgacattgagggtttccaccacggcggtctgctcttcggtggcggccgccaccgactggttcatgccgtcgatctcggtgatgcgctgggtcacgctgaccagccgcgcaccagcctggttggccacttcgacgctctcttcgctggacgcctggctggcgttcatggtcgataccgcttcgcgggagccgatctgcagcgaggtgatcatcttgtggatctcttcggccgactcctgggtgcgatgggccaggttgcggacctcgtcggccaccaccgcgaaaccgcgaccggcttcaccggcgcgcgccgcttcgatggccgcgttgagcgccagcaggttggtctgctgggagatgcctttgatcacatcgaggatgtggccgatgttgtcggtgctggcgttcagggtttcgatctgggtgcaggacaggctgatcttctgcgacagctcggtcatggccaggatggtttgttccaccacctggcgaccatcgtcggcctgctcgctggcgccgctggcgtgctgcgaggcatcggcggcgttgcgggcgatttcctgggtggcggcgcccagctggttgatcgccgcggccacgctgttggtgcgcgcgctttgttcgtcggaaccgatgatcgaggcgttggacgaggccatcacgcgctgggacaggtcatgcacctggcgggtggccgaggacacttcagaaatcgatgcgtggatacgttccacgaactggttgaacgagccgcccagtacgccgaattcgtccttgctctccaccaccaggcgacgggtcaggtcgccctcgccctgggcaatgtcctgcatcgcgcggcccatggtggtcagcggacgcatcagcacctggatcagcaggctcagcagcacggcaatcgcggccacggcgatgaacatcgccagcagcgccgaggtgcggaacttgctcagcggggcgaacgccttgtcacggtcgatggacaggccgatgtaccactcggcattcggcaggccggtcaccggggtgaacgacaggatgcgttcctggccgttgagcagcacttcctgggtgcctttctggatacgcacgttggcgcccgggtagacatccttgaggttcttcatcacctggtccttgtccgggctgacgatcacctgcccgtccgcgctgaccaggaaggcatggcccaggccgccgaagtccaccgagttgatgatcttcaccagggtttccaggctcaggtctccccccaccacgcccagcaactggccgtcctttttcaccggcatggcgatggtcaccaccagcccgccaacggccgccatgtagggcggggtcagcatggtcttgtcggccgccacggcctgcttgtaccagggacgctgacgcgggtcgtagccgtccggcatcttcgcgtcaggccgctgggtgaacacaccgttggcctggcccacataggtgaactggaagttcgtggtgaacgccggctggtccaccagccccgggaagtcggcgttggcgccctggtgggcgacgttctgcgagaggttctcgagcaccaggatgcgtccgctcatccagttctgggcgctgctggaagtgaggtcacccgcctgctcgatggacgattcgaggttctggcgaatggtgtttcgctgcagatagtcgttgtacaaagtgaacaacgcgaatgccagaaccactacaccggaggcggccaaaaggattttatggctgaacttgagattcatgtcatgggacttcttatgccgaaagtggggatgcgtacgggatgcaactttccatgtaacaacgcaggcggcgttctacgaccgctctactttggtgcacgcatgggtctcactgtctgtcggcacgagacggataaatcttagcgatttgtcagaaatgtacctgttatctgcaaaaaaccgctgaacggcaggctagagcggtcgcgtcggacttttccgtagccggtcgccctgcggctgttgcaaaatcccaaacccttgatgacaatgcgactaattatcatttgtgacacccagacagtcgcatccatgtcatcacctgagttcgcggtacaggcgctttacagccatcaccatggctggctcaacacatggttgcgcagccggctgggcaatgccgccgatgccgccgacctggcgcaggacaccttcgtgcgcctgttgcagcgcaccgaacgcctggaactcaaggccccgcgcgccttcctgcggaccattgcccgcggcctggtgatcgaccactggcgccgcgaggaaatcgaacgcgcctacctggaaaccatcgcccatctgccgcaagcccaagcccccagcgaggaagcccgcgccctggtgctggagctgctggaaagcatcgcgcgcatgctcgaaggcctgaagccgaaagtgcgcaaggcgttcctgctggcccagtgcgagggcctgacccacaagcagatcgccgaacagatgggactgtccctgcgttcggtggagcgttacgtggccgacgcgctgttccactgctacctgctgcgctatgaggcttgagcgctgtggataacccttcgatcaatctgcgccgacccgtggaccccaggcacctggtggtcaagcaggccatcaactggatgctgcgcctgcgcaacaacgccggtaacccccggctgctgcagcaatgcgatacctggcgcgcggcccatcacgagcacgagctggcctggcaacgggtgcaatcgctgcagcaggaactgcacagcaacctgcgggcggtacccggtgcccaggtggccttcgataccctggaaaacagcgcccagcgcctcggccgacgccaggccctgaagctgctcggcggcgtcatgctggtgggctgcgccgcgtggctgggcaaggagcaactggcctggcagcaatggaacgccgacttcgccaccgccaccggcgaacgccgcggcttccagttgccggacggctcgcgcctggaactcaacaccgatagcgccgccgacatggacttcaatgcccggcagcggctgatccggctcagccgtggggaaatcatgctgacctgcggcccggactcgcaggcgagcccttccaggccgctgctggtacggactcgccatggcctgttcgaaggcttcgacgccagtttcgtggtgcgcatggagggcgactgcacgcgcctgagcgtgaccgccggcagcgtcgccattcattcgccgcacaccgccgatggcgcctcggcccgggtacaggccgggcaaagctatcgggtcagtgcgtcccaggcgctgccggtaccaccgctggacatggacgtgggcgcctgggccgatggcctgatcgtcacccgcaatatgcggctggcggacttcatccacgaagtcggacgttatcgccacggttacctgggctgtgccgacgagatcggcgacctgcgcctgtccggcgtgttccgcctggaggacaccgacaaactgctggcgatcctcccgcaaaccctgcccgtgcgcctgcgttatcgcacccgttggtgggtcaccctggaacgtctggcctgaggcgctgcaattcgttgaaatttttttggcggctttttcccgtgagtccggcttagacagtaagcacttccatctgccttcagcgactcaacggaacccttccatgattgtgcacttccaccactcttcttctgcacggcccgccctcggcctgcgccatgccgtgcgcgtggccctgctttcctcggcgctgggcgtcgccgccttgccttgcctggcacaggcggccgagtctggcgcggccagcctcagccacagctacaacatccccggcggcgccctgagcgacgtactcaaccgcttcgcccgcgaggccggcatcaccctgtcgatgaccccggcgcagctccaggggcgccagtccgccggcctgaagggcgagtactccaccgaccaggccctgggccaactgctcaacggctccggcctggaagcgctgagccaggacggcagcagctacgtgctgcgggccttgcccgagaccggcgccctggcgttgccgaccaccgacatcaagggtttcgccctgggcaatgccttgggcagcatggaaggctacaacgccacccacagccagatcgccaccaagaccagtaccgcgctgctggaaacctcgcaaagcgtctccgtggtgacccgcgaacaaatggacgaccagggttcgcaaaccgtgtcccaggccatgcgctacacccccggcgtgctgaccaacccctacggcgcgacccacaggtacgactacgtggccatgcgcggcttcaacgacggctcggtggacaacatctacctcgacggcctcaagtccatgggcgacagcggcacctacagcaccatgcaggtcgatccgtacttcctggagcgagtggacatcctcaaggggccttcgtcggtgctttacggccgcagctccccgggcggcctggtggcactgaccagcaagaagccgctgttcgagccctaccatcagatccaggccacggtcggcacccagggccagcgcggcatgggcttcgacttcagcggcccggtggacgacgacaagcgcatcgcctatcgcctgaccgggctggcggaccgctccgacacccagttcgaccacaacaaggaaaaacgctacgccctggcaccgaccctgagcatcgacttcaccgatgacacctcgctgaccctgcaggcgtacctgcaacacgatccggacggcggctaccacagcggcatgccggccgacggcgcgttgcaccagcgcaacggccagcggatttccgagaacttcttcgaaggcgaaccgggcatcgatcgctacaagcgcgatcagcagtcgttcggttatcagttcgaacatcgcttcaacgatgtcttcaccgcgcggcagaacttccgctacctggactccaaggtgaagctggaccaggtctacggctacggctggaccaccccgaccagcaacgagctgaaccgctactacaccggcggcgacgagaagctgcatgcgttcatcgtcgacaacatgctgcaggccgaatttctcactggcgcgaccaagcacacggtgctgatgggcgcggattaccagcggcgcaagacggtggtggactggaccagcggctcggtggcgccgatcaatgcgttcgatccggtctatggcaactcggccatcagttactacgacccggtcagctatctgcgtcgcctcgagcagaccggcgtctatctgcaagacctgatcgagatggacaagtggcgcttctccctgggcctgcgccaggactgggtagagacctcggacgagaaccgcctggccgaagcctcgcgcccggtgggcaccgagatcaatgacaagcgcaccaagctgaccggccgcgccggggcgctgtacctgttcgataacgggttggcgccttacatcagctattccgaatccttcaaccccaactcctacgcggacagcgccggcaacccgctggcgcctaccgatggcacccaatgggaactgggcctgaagtaccagccaccgggcacggatgacctgtacaccgcgtcgctgttccgcatcgaccaggaaaacctggccaccaagctgccccaggaaaacttctatcgcgcggtcggcgccgtacgctcccagggcctggaactggaagcgcacctgcaattgaacgacaacctcaagctgctcggcagctacaccttcaccgatatcgagtactcgaagtcgatgatcagcaccttgagcacggccaccgacatcatcgagaacaagggcaactcaccgacccaggcgccgcggcacatggcttcgctctgggccgactacaagttcgacagcggctcgctcgacggcctgcgcctgggtggcggcgtgcgctatgtcggctacagctgggcggatgcggagaacaccatgaaggtgccgtcctacaccctgttcgatgcctccgtcggctatgacctgggcaaggtcggcctgaagggcgtggatgtccggctcaatgccaacaacctgaccaacgaatcctacatcgcctcctgtgccagcctgagcttctgctacatgggcgaggagcggaacgtcgccgccacggtcagctaccagttctaatcatttgtcgttcccccgaagccagcgcacgcgctggctttgtcgtctctacgggaaaattccatgcgcgcaattctggttctactgcatcgttatatcggcctggccaccgcggtatttctgctgctggcagggctgaccggcagcctgctggccttcaatcacgagctggacgagtggctcaacccggggttctacgaggcccctgccgagggtcaggcactgccgcctggaagcctggtcgaccgggtgcagacacagcatccgcgcctgcaggtctggtacatggagtaccccaatgagcccgggcataccgcactgctcgccgcagtgccgcgtaacgatccggccacgggcagacccttcgacgaccccaaccaggtgttctatctggacccggtcagtggcgagcagaccggcaaacggttctggggtgcctgctgttttcagcgggagaatctcatccccttcattctcgaattccactacaacctgacgctgccgggtaactgggggctggtgttgatggggctggtggcgatcttctgggtcatcgattgcttcatcgccttgttcctcaccctgccccgtggccggccgttctggaagaagtggtcgaccgcctggaagatcaagggcgggcacgcctatcgtctcaacatggatctgcatcgcgcgggcgggttatggctgtggttactgctgctgccgatagcgatcagcagcgtggcgatgaacctgccgagccaggtgttcaagccggtggtttccctactctcaccgatcgagccgagcgtctatgaagctcgtgggcgcatgcccagcgatcagttgggggttacccggctcacctatcagcaggcttatgaacgcgcccgggaagaaggcaaacggctgggcctgacagcagcgatcggcgagctgtattacagtttcgaatacaacttctatggcgccggtttcggtcagcacgataccgaggcccatggtaagtcgtggttgttctttcatggcaccgatgggcacctgttgggacaggagatcgccgggcaaggcaccttgggtgaacgtttttttcggctgcaactgccgatccatggtggccggatcattggctttaccgggcaggtacttattgcggtgttggggttggtgattgcggtgttgtccgtcaccgggatctacatctggtggcgtaaatggctggcccgcagaagcagcaagatgcgtcagcggtgaggtgagggatagagcggaggtgcttcgctctgttctgatgttgtggagcataggttggggactgaaggggattcagctcacctgctaggtgacttggagacctggcttggatgtaagcctcaaggctttcaggcgtacaaaaacaaaacccctgtctgcgtcagcagacaggggtttcggaattcaatcttgacgatgacctactctcacatggggaaaccccacactaccatcggcgatgcatcgtttcactgctgagttcgggatgggatcaggtggttccaatgctctatgctcgtcaagaaattctgtggccggaccgttggctcaagggccgaacgtgccagcaaaatcgggaacttctacaaaaacaaaaccccaattgctttcgcaattggggtttcggaatttaatcttgacgatgacctactctcacatggggaaaccccacactaccatcggcgatgcatcgtttcactgctgagttcgggatgggatcaggtggttccaatgctctatggtcgtcaagaaattcggtgtgccgacgcgtctttcgacgtttcagcaaattgggtatgcgatagtttgtgtgttttctcgaactttcggttcgtttcgtcttcacacaccgcaatctggctgttaagcgcaaattgcttgggtgttatatggtcaagcctcacgggcaattagtattggttagctcaacgcctcacagcgcttacacacccaacctatcaacgtcgtagtcttcgacggccctttagggaactcaaggttccagtgagatctcatcttgaggcaagtttcccgcttagatgctttcagcggttatcttttccgaacatagctacccggcaatgccactggcgtgacaaccggaacaccagaggttcgtccactccggtcctctcgtactaggagcagcccctctcaaatctcaaacgtccacggcagatagggaccgaactgtctcacgacgttctaaacccagctcgcgtaccactttaaatggcgaacagccatacccttgggaccggcttcagccccaggatgtgatgagccgacatcgaggtgccaaacaccgccgtcgatatgaactcttgggcggtatcagcctgttatccccggagtaccttttatccgttgagcgatggcccttccatacagaaccaccggatcactaagacctactttcgtacctgctcgacgtgtctgtctcgcagtcaagcgcgcttttgcctttatactctacgaccgatttccgaccggtctgagcgcaccttcgtactcctccgttactctttaggaggagaccgccccagtcaaactacccaccatacactgtcctcgatccggataacggacctgagttagaacctcaaagttgccagggtggtatttcaaggatggctccacgcgaactggcgtccacgcttcaaagcctcccacctatcctacacaagcaaattcaaagtccagtgcaaagctatagtaaaggttcacggggtctttccgtctagccgcggatacactgcatcttcacagcgatttcaatttcactgagtctcgggtggagacagcgccgccatcgttacgccattcgtgcaggtcggaacttacccgacaaggaatttcgctaccttaggaccgttatagttacggccgccgtttaccggggcttcgatcaagagcttcgcgttagctaaccccatcaattaaccttccggcaccgggcaggcgtcacaccctatacgtccactttcgtgtttgcagagtgctgtgtttttaataaacagtcgcagcggcctggtatcttcgaccggcatgggcttacggagcaagtccttcaccctcaccggcgcaccttctcccgaagttacggtgccattttgcctagttccttcacccgagttctctcaagcgccttggtattctctacccaaccacctgtgtcggtttggggtacggttcctagttatctgaagcttagaagcttttcttggaagcatggcatcaaccacttcgtcacctaaaaggtaactcgtcatcagctctcggccttagaaccccggatttacctaagattccagcctaccaccttaaacttggacaaccaacgccaagctggcctagccttctccgtccctccatcgcaataactagaagtacaggaatattaacctgttttccatcgactacgcttttcagcctcgccttagggaccgactaaccctgcgtcgattaacgttgcgcaggaaaccttggtctttcggcgtgggtgtttttcacacccattgtcgttactcatgtcagcattcgcacttctgatacctccagcaagcttctcaactcaccttcacaggcttacagaacgctcctctaccgcatcacttacgtgatacccgtagcttcggtgtatggtttgagccccgttacatcttccgcgcaggccgactcgactagtgagctattacgctttctttaaagggtggctgcttctaagccaacctcctagctgtctaagccttcccacatcgtttcccacttaaccataactttgggaccttagctgacggtctgggttgtttcccttttcacgacggacgttagcacccgccgtgtgtctcccatgctcggcacttgtaggtattcggagtttgcatcggtttggtaagtcgggatgaccccctagccgaaacagtgctctaccccctacagtgatacatgaggcgctacctaaatagctttcgaggagaaccagctatctccgagcttgattagcctttcactccgatccacaggtcatccgctaacttttcaacggtagtcggttcggtcctccagtcagtgttacctaaccttcaacctgcccatggatagatcgcccggtttcgggtctatacccagcgactaaacgccctattaagactcgctttcgctacgcctcccctattcggttaagctcgccactgaatataagtcgctgacccattatacaaaaggtacgcagtcacagaacaaagtctgctcccactgcttgtacgcatacggtttcaggatctatttcactcccctctccggggttcttttcgcctttccctcacggtactagttcactatcggtcagtcagtagtatttagccttggaggatggtccccccatattcagacaaagtttctcgtgctccgtcctactcgatttcatgactaagagattttcgcgtacagggctatcacccactatggccgcactttccagagcgttccgctaatctcaaagccacttaagggctagtccccgttcgctcgccactactaagggaatctcggttgatttcttttcctcagggtacttagatgtttcagttcccctggttcgcctcttgcacctatgtattcagtacaagataaccatcttatgatggctgggttcccccattcagacatctccggatcaaagtctgtttgccgactccccgaagcttttcgcaggctaccacgtctttcatcgcctctgactgccaaggcatccaccgtatgcgcttcttcacttgaccatataaccccaagcaatctggttatactgtgaagacgacattcgccgaaaattcgcgattaaactcacaaattttaccttagcctgaataaacaccagtgaaagtgctatccagtctatctttctatcacatacccaaatttttaaagaacgattctgataaagatcagaaatcaacattcaccatcaacttgatggaatgctcatttctaagctttaaacgatggacaccaatctgtaatggtggagccaagcgggatcgaaccgctgacctcctgcgtgcaaggcaggcgctctcccagctgagctatggccccgtatcgctacagggtgcaccagtaattggtgggtctgggcagattcgaactgccgacctcacccttatcaggggtgcgctctaaccaactgagctacagacccaatcgtcttcttcaatgaatcaagcaattcgtgtgggagcttatgaagcagctgatgtcgtcgattaaggaggtgatccagccgcaggttcccctacggctaccttgttacgacttcaccccagtcatgaatcacaccgtggtaaccgtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttgtgggattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccattacgtgctggtaactaaggacaagggttgcgctcgttacgggacttaacccaacatctcacgacacgagctgacgacagccatgcagcacctgtctcaatgttcccgaaggcaccaatccatctctggaaagttcattggatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaagagctcaaggctcccaacggctagttgacatcgtttacggcgtggactaccagggtatctaatcctgtttgctccccacgctttcgcacctcagtgtcagtatcagtccaggtggtcgccttcgccactggtgttccttcctatatctacgcatttcaccgctacacaggaaattccaccaccctctaccatactctagctcgccagttttggatgcagttcccaggttgagcccggggatttcacatccaacttaacgaaccacctacgcgcgctttacgcccagtaattccgattaacgcttgcaccctctgtattaccgcggctgctggcacagagttagccggtgcttattctgtcggtaacgtcaaaatactcacgtattaggcaagtacccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaactagctaatccgacctaggctcatctgatagcgcaaggcccgaaggtcccctgctttctcccgtaggacgtatgcggtattagcgtccgtttccggacgttatcccccactaccaggcagattcctaggcattactcacccgtccgccgctctcaagagaagcaagcttctctctaccgctcgacttgcatgtgttaggcctgccgccagcgttcaatctgagccatgatcaaactcttcagttcaaacatctttgggttttgagaaaaccctaaacttggctcagcaatcgttggttacatctttgatttctcgcggagtaacttgtgatgctgataatctttctgactatcagtctgactccacaagcacccacacgaattgcttgattcagttgttaaagagcggttggttaagcctttcgtctcaaccgaggcgcgcattctacagcagcctctgtatctgtcaagcggttattttaagaagctttcaaagtttcctttgcaacttcaaccacttgcgcttccgatctctcgtcagcgggaggcgaattctacagcgttacacgctgctgtcaacacctctttttctccgctttcgaccgagaagatcgaatcgttaacccggcgaaaacatactgccgaatcaactccttcgggcttcgatgaactgaagcgtggccgctgtcgaaaaccgtgtaactcgttgaatctcaaggagttttccgtttcgactgcgccggaagtggggcgaattatagacttccagaatctgccgtcaacccctaatttgcttttactatgaataaacctgaaaacaccccaaaaggggtgttttcaggcctcttatatagaagggatcagatgctctctatatagaagagcgcattcacaccacgcccgaggctcgcaaggcatccacgaactcaagctcaagccccagcactcgctgcagaacctgggcggtatgctctcctaatagaggaggcgcatgacggtactcgaccggcgtctcggagagacggatcggactcgccacctgaggcaccaaccccgccaacgcgtgaggcagctcgatcgccaacccgcgcgctttgacctgcgggtcctcgaacatctgcgccaagtcgttgatagggccgcaaggcacccccgcctgctccaactgggcaacccactcagcggtggtcttgaacaccgtggcctgacggatcaatggaatcagcaccgcccgattggcaacccgtagcttattagtcgcaaagcgcggatcgtccgcccactgcggctggcccgccacctcggcaaacttgcggaactgcccgtcattccccacggtaaggatgaaatcgccatccgccgtgggaaagtcctgataaggcacgatattcgggtgagcattacccaggcgcttgggagcgactccggtggtcaggtagttcatcgcctggttggccaggcacgcaacctgtacatccagcaacgccatatcaatgtgctgcccaccaccgtcatgctgccggtgcgccaatgcggcaagaatcgccacagtcgagtacaaccccgtcaggatatccgtcaatgccacgccgactttcaccggcccggcaccctcatcaccctcgggacgcccggtcaggctcatcagcccgcccagcccctgaatcatgaagtcgtagccggcacgcttggcataaggcccggtctggccgaagccggtaatggagcaatagatcaggttagggttgagcgccttcagcgactgatagtccaacccataggccgccagaccgccaaccttgaagttctcgatcagaatgtcggacttggccgccaactcgcgcaccaggcgctgaccttccggccgagtgaagtcgatagtcaccgattgcttgttgcggttggccgacaggtaataggcagcctccgtagtgttctcgccataggcgtccttgaggaaaggcggtccccaggcgcgcgtatcgtcaccgttacccggacgctcgaccttgatcacctcggcccccaggtccgccaggatctgaccggcccaaggcccggccagcactcgcgacaagtccagcacccgcaaatgagataacgcgcccatggtcgttctcctatcagtagaacgcctggatgccggtctgcgcgcgccccaggatcagcgcatggacgtcatgggtcccttcgtaggtgttcaccacttccaggttgaccaggtgacgggcgatgccgaactcgtcggagatgccgttaccgcccagcatgtcgcgggccatgcgagcgatgtccagcgacttgccgcaggagttgcgcttcatgatcgaggtgatttccaccgccgccgtaccttcatccttcatccggcccagacgcaggcagccttgaagggcgagggtgatctcggtctgcatgtccgccagttttttctggatcagttgggtagccgccagcgggcgaccgaactgctgacggtccagggtgtattggcgagcggtgtgccagcagaactcagctgcacccagggcgccccaggaaataccgtagcgggcagagttcaggcaggtgaacggacctttcaggccacgtacatccgggaagatgttctcttccggaacaaagacgttgtccatgacgatttcgccggtgatggaagcgcgcaggccgaccttaccgtgaatcgctggagcactcagacctttccaacctttctccagtacgaagccgcggatatccccagcatcgtccttggcccagaccacgaacacgtcagcaatcgggctgttggtgatccacatcttgctgccagtcaggctgtaaccaccgtcgaccttacgagcacgggaaatcatcgcgcccgggtcggagccatggttaggctcggtcagaccaaagcagccgatccactcgccagaggccagcttcggcaaatacttctgcttctgggcttcggtaccaaattcgttgatcggcaccatcaccagggaggactgcacgctcatcatcgagcggtagccggaatccacacgctccacttcgcgggcaatcaagccgtagcagacatagttcagaccgctgccaccgtactgctcggggatggtggcacccagcaggccaacttcgcccatttcgcggaagatcgccgggtcggtcttttcatgacggaaagcttcgagcacacgcggcgccagcttgccttgagcgaattgctcggcactgtcgcgcaccatgcgctcctcttcagtgagctgttgatccagcaaaaggggatcgatccagttgaagcttgctttaccgcccatgagtgagtcctcgtgaagtaggtcaacgttcgtggactgatcctaggccggctttgcgggcgcagcaaacgaggatttcgcatactgttgtgctaatttctcactccgtaacagccgcaagcggcttttagcgattccattagtgagattgccgtacatgcgcagaaagatccccagcactgccgccctcatcagcttcgaagccgccgcacgtcacgagagctttaccaaggcggcgcaggagctttcgctgacacaaggtgcaatttgccgacagatcgccagcctggaagagtttctcggggtcgagctgttccgccggtcccgacgcggcgtcaagctgaccgaagccgggctctcctacagccgccgcgtggcaactcaactggacgcggtggagcgcgacaccctttccgtcatgggccagcagggcgccaacgtcatcgagctggcggtggtcccgacctttggcacccaatggctgctgccccgactcaaggattttcagcagcgacacccggaagtcacggtcaacctgaccaaccgcacccggcctttcctgttcgccgataccgacttcgacgcagcgatttactttggcgatgccgactggtcgggcacccaatcccatcgcctgatgggagaaaacccgatgccggtatgcagccccgcaaccctgggcaaccgcacccggctaagcgccgaagaaatcgccgagttgccgctgctgcaacagaccacgcgcccctatgcctggcggcaatggttcaactcacagcacctgaatatcccgcgagacatgacaggcccgcgttacgaactattctccatgctggcgcaagccgccatgcacgacatgggtattgccctgatcccgccattccttattcaacgggagttgagggaaaagcgcctggtgatcgccaaccccgaagcactagcaagcatcaaggcgtattacctgatgattcccgagcgcaaggtggaatcagcgtctttacgggcttttcgcgattggctggtggagcaggcacaaagctacagccttgagaaatagcggggcagggcagcaagctgacttagtagtcaggaaaaaccaagcactacagatataactaaatgtcgcatttaggcagactgtatcgataagcggaacaaccgtcctataagcgcctaaccacgtggcttgtagggctttttgagggtcataaacgctcattcacgcgagcaatatgaaaattgttttattttccgtctaaatccttacaggtcacggcttacaagggattggcccagacccttgcgacattcggtcacagggtgacttgtagttaattttccgtcaccactcataatcccttgaagggcgtaatgttcgcctgcaaaatgccgcgccccgccttgattctggcgggatcgtgctgatcggccgccccagctgcaccatccgtagtgcgctggccttctagaaaagatcgaaagcaataagatccaagcaggagatttgacgtgcacattggtgttcctctcgagacccaaacgggtgaaacacgggttgctgcaaccccggaaaccatcaagaaactgatcggccagggtcataaagtcactgtgcagagcggcgccggcatcaacgccagtgttgtcgacagtgcctatgaagcggcaggcgcaaccattggcagcgcccacgatgcattcggcgcagagctgattctcaaggtcgtggctcccagcgacagcgagctggccctgatcaagagcggcaccgtcctggtgggcatgctcaatccgttcagcaatgaaaccattgccaagatggccgagcgcggcatcaccgccttcgccctggaagcagcgccgcgtacctcgcgggctcagagcctggatgtgctgtcctcgcaagccaacatcgccggttacaaagcggtgctgctggctgcccactattacccgcgcttcatgccgatgctgatgaccgccgcgggcaccgtgaaagccgctcgcgtgctgattctcggtgccggtgttgccggcctgcaggccatcgccaccgccaagcgcctgggcgccgtgatcgaggcctcggacgtacgtccggcggtcaaggaacagatcgaatccctgggggccaagttcgtcgacgtgccttacgagaccgatgaggagcgtgaatgcgccgtcggtgtcggtggctacgcacgtccgatgcctgccagctggatgcaacgccaggcccaggccgtgcacgaacgcgccaagcaggcggacatcgtgatcaccaccgccctgattccaggccgcaaggcgccagtactgctgagcgccgaaaccgtggcccagatgaagccgggatcggtggtcgtcgacctcgccgcggcccagggcggcaactgcccgctgaccgtggcggatcaggtggtcgtcgagaatggcgtgaccatcgtcggcccgaccaacctggccggcgctgtcgctgccgacgcctcggcgctgtacgcccgcaacctgctggacttcctgaagctcgtcttcaccaaagaaggtcagttcgaggtcaacctagaagacgacatcgtcgccgcgtgcctgatgtgccgcgacggccaagtcatccgtaaaaacgcctaagcagggattcagacgatggaagagcttatctcccccggtatctacaacctgatcatcttcgtgctggcgatttatgtcggttatcacgtggtctggaacgttacacccgcactgcacacgccgctgatggcggtgaccaacgccatttcggcgatcgtgatcgtcggcgccatgctggccgccgccctgaccgtgacaccgctgggcaagaccatgggcacgctggccgtggccctggccgcggtcaacgtgttcggcggcttcctggtaacccgccgcatgcttgagatgttcaagaaaaaagccccgaaagccgtaaaagaagaggcgcccaagtaatgagcatgaatctggtaacgacgctctacctgatcgcgtcgatctgctttatccaggccctcaaaggcctgtcgcacccaacctcctcgcgtcgcggcaacctgttcggcatgctcggcatggccctggcgatcgtcactaccgtcggcctggtgttcaagctcggcgcggagctggcgaccgttggcatcggctacgtgatcgtcggcctgctgatcggtggcaccgccggttcgatcatggccaagcgcgtggaaatgaccaagatgccggagctggtggccttcatgcacagcatgatcggtctggccgcggtattcattgccattgccgccgtggtggagccgcagtccctgggcatcgtcaagcagctgggtgatgcgattccggccggtaaccgcctggagctgttcctcggcgcggccatcggtgccattaccttctccggttcggtgatcgccttcggcaagctgtcgggcaagtacaagttccgcctgttccagggcgcaccggtacagttcggcggccaacacaagctgaacctggttctcggcctggcgaccctgggcctgggcgtgaccttcatgctcaccggcaacctcggcgccttcgccctgatgctggtcctggccttcgtgatgggcgtgctgatcatcatcccgatcggcggcgccgacatgccggtggtggtgtcgatgctcaacagctactcgggctgggcggcggcggggatcggcttctcgctgaacaactcgatgctgatcatcgccggctccctggtgggttcgtccggtgcgatcctgtcgtacatcatgtgcaaggcgatgaaccgttcgttcttcaacgtactgcttggcggcttcggcaacactgccgacgccggcggcccggcaggcgcgcaagaggcccgtccggtgaagtccggctcggccgacgacgccaccttcctgctgaccaacgccgacaccgtgatcatcgttccgggttacggcctggcggtcgcccgggcacagcacgcgctgaaagagctgaccgagaagctgactcaccgcggcgtgaccgtgaagtacgcgatccacccggtagcaggacgcatgcccggccacatgaacgtgctgctggccgaggccgaagtgccgtacgaccaggtgttcgagatggaagacatcaactccgagttcggccaggccgacgtggtgctggtgctcggcgccaacgacgtggtcaacccggcggcgaagaacgatccgaaatcgccgatcgccggcatgccgattctcgaggcgttcaaggccaagaccatcatcgtcaacaagcgttcgatggccagcggctatgccggtctggacaacgaactgttctacctggacaagaccatgatggtgttcggtgacgccaagaaagtcatcgaagacatggtcaaagccgtcgagtaaaacctgctccagcgcaacacccaagacctcagcctttagtaggctggggttttttatttcccgcacaaacccgacaaaaggctctaaatcgcggcctttcattcgaccttggtagcgggacgaatttttttgaaatcactagactgcgcatcttgcttccgctgcccgagataacaatccatgtaccgtgatcgtatccgcttgccttcgttgttggataaggtgatgagcgccgccgacgctgccgctctgattcaggacggcatgaccgtcggcatgagcggtttcacccgcgccggcgaagccaaggccgtgccccatgcattggccgagcgcgccaaggtaaccccactgaaaatcagcctgatgaccggcgccagcctgggcaatgacctcgacaagcaactcaccgaggccggtgtcctggcccgacgcatgccgttccaggtcgacagcaccctgcgcaaggcgatcaatgccggcgaggtgatgttcatcgaccagcacctgtcggaaaccgtggaacagttgcgcaaccagcagctcaagctgccggacatcgccgtcatcgaagccgtggcgatcaccgagcagggccatatcgtgccgaccacctcggtgggcaactccgccagtttcgcaatcttcgccaagcacgtgattgtcgagatcaacctggcgcacaacccgaacctggaaggcctgcacgacatctatatcccgacctaccggccgacccgcacgcctatcccgctggtgaaggtcgacgaccggatcggcagcaccgccatcccgatcccggcggagaagatcgtcgcgatcgtcatcaccaaccaggcggactcgccatccaccgtctcgacccctgacagcgaaacccagggcatcgccaatcacctgatcaacttcttcaagcaggaagtggacgctggccgcatgagcaacaagctcggcccgctgcaagcaggcatcggcaacattgccaacgcggtgatgtgcggcctgatcgaatcgccgttcgaagatctgaccatgtactccgaagtgctgcaggactcgactttcgacctgatcgacgccggcaagctgagcttcgcctcaggcagttcgatcaccctgtcgagccgccgcaacgccgatgtgttcggcaacctggaacgttacaaggacaagctggtactgcgcccgcaggaaatctccaaccacccggaagtagtgcgtcgcctgggcatcatcggcatcaacaccgccctggagttcgacatctacggcaacgtcaactccacccatgtctgcggtacgcggatgatgaacggcatcggtggttcgggtgacttcgcgcgcaacgcgcacctggcgatctttgtcaccaagtccattgccaaaggcggggcgatttccagcgtggtgccgatggtcagccacgtcgaccacaccgagcacgacgtcgacatcctggtgaccgagatcggcctggccgatttgcgtggcctggcgccacgggagcgggcacgggtaatcatcgacaactgtgtacatccggactatcgccaggcgctgaatgactacttcaccgccgcctgcgccttgggcggtcacacgccacacgtcctgcgcgatgccctgcgctggcacatgaacctggaagaaaccgggcgcatgctcactgtgtgatgggtacagtcgatggctgacgcaagtccagttgtgtcagcccatcgacaatccttaaacacccatcaaaaactgtactgctgtaccggtattttaccccctcaaaatcctatctttttcaagaaaaccccttgatacgcacctaaatggtgccgacaggtacagttgcatcatttccgaacagtacagcacctataaacagttaactggtccctcacaatacagatgaactgtatctacagagactagcgcgagaggaggatcatgggcaccagttaaaccactacctaatcccgccacaagcggaaggatgcacatcatggaacgtacactcagttccgaactgttcttcgaagacaaagctgcaaaaacccagacttccatgcctctgcgcgttctcgccaacctgatgctgtggcagcgccgcatctccagccgccatcaactggctcgcctggattcgcgtctgctggctgacgcaggtatcagcgaagctcaacgctatgaagagctgagcaagccgttctggcgctaagttagcgtcgctggctctgacccaccgggtccaccgccagcaccccgaattgaaaaaacaaaaccccgtcgcgggcaaccgcgacgggttttgtcgtttaaggcctggcaatgccggaagccgccggtacagaaagggtatggctcgacagatacagtttaaatataaacaaaactgaaccagtacaatttcataccggtgtatctgtatgcgtgcctggatgaatagcaacatggtgtcccaagtccctgacttcggcctgccgaaaggaccgcaccatgaaccacataccaggacgtatcgcacctctcagcttttcccatcctcagataagcgtgtggaaacgcctgtaccgcgccttgtgccagatgcagcagaacgcccgaacacgccgcgtgctggcaggactcaacgatcagcaattgtccgatgtaggcatcagccacagcgaccgcatggccgaactggacaaacccttctggcgctagttcgcatcaggacagcagaagagggctattcgaacagatggggtgggcctaatatccggtagcgtgtagcgattttcctgaaggggcgtctgattcatttgccccacagtgactacccggtgcccactcagcaccaccctatctgttatcaaggagttttacctatgtcccgtcttcgcctgctcagcgctgctgccttgctggccttggcctccaacgcccacgcctccagctttatcgttaccaccgatgcggtagtcggcgcactcaaggccacttccgatgcgacttccgacgtcacatcctcgttccgtgacaacaaaatcgtgcgcgccgctcgtgacgacgccgccagttttgtcgctaccgaaggtgccattcgcggtgtgaagctggaaagcgcgtttgaccacatccgccagcagttgccacaactgagcgctactgacgcccagctcgctcaggccatcctgacgatctgacttccggtccggtgacgggtgcgcccaacgcacccgaaaccctgggcgctggctctcgcccgggcattgcgctagccttgccgctggtttttcagctgtcgagactcatgcgttttttcagatccctgcttaccgtcccttcgttgattgccgtttgctggacaggctcggtcgctgctttcgacttgagcacacaaggcctggtcatcactggctacgccaccagcaaggtgacctccgcgcctttcgacaacaaacgcgtactggctgcccaggatgatgccgcggcgttcattgccactgacggccacctgcgcggagcccggctggaatcagccctgaaatacctgcgtaaaacccagccacaacttcatgtcggcgaccttgaactggcgcaggcaattctcgtccaataactatccctgtcatcccggagtcgttccatgcgtagcccgctgattgctgccacccttggcctgttgctgttggctgatgtggcccaggcgcaaaccctggtagccaccagtaacatcatcgttcgagcctttggtcgtaccatcgatttcacctcggacaccaccacctccatccgcgactcgaaaatcgtacgcgcggcccatgacgatgccgccagcttcgtcgccagcgacggcgatattcgtggcgcccaactggaagccgccttcgataccttgcgtaaccgtgtgccgcaagcccgcgacgccagtgatcaggtgctcgccgaagccatcctcgcactgtgaggccgctcgccgcctggctgctgggcgcagcgctgttactcctgggcaacagcgctcaggccggcctgcaactgcggctcaagaccgaaggcttgagcccggagcagcagcacgccagccaggcactgctggatgaagcgatgcaagcgctaccgccgcgcttcatcgaacaactggaccaccgcatcgatgtcggctggaccgacgacatgcctcacaacgcctacggccaggcatcgctggtcgacgaactcgacctgaatcgcaaactgctggccaacctcaccgacggcagcgcggccacgcagaaaacccatcgacctcatggcaccgtgcgccgggaaatgctcgccaccgtgctgcatgaactcacccatatttatgaccgttcgcgcctgtggtcgggtgccgaacgcacgctgatccagcgttgcagccgccagaacagcgcctcgggcctgatcgggctgccggaccagtgccgcggccagaccgcgcgccgcttcaccctcagcgacgacccgcgcctgctcgacctcgccggctggccgcaatacgtcggccgccgcggcgaacgcgagcagtacaaccgccaggtcgcccgcagcccggatatctacgaaacgaccaaccccaaagagttcgtcgcggtgaacatggagtacttcctcctggacccgagctacgcctgccgccgaccggcgctgtaccgttattaccaggaacacttcggctgggcgccgaaggccaaggacacctgcgcccagtccttcgccttcctcaacgccggcaacgacttcgccaagcagccgctgggcaaggtcgacccggagcgggtctatgccgtggattacctgctggccgaagccaaccagaactgggtcagccgctgggggcacagcatgttgcgcctggtgatctgcgcacctggccggccacgcgggccggattgccggctggacctcgagcagcacctggtgctgtcctaccgcgcctttgtcggtgacgtgcagttgtcgagctgggacggcctggtcggcaaatacccgtcccgcctgtttatcctgccattggcccaggtcatcgacgaatacaccaagaccgagctgcgcagcctggcttcggtgccgctgaacctgtcgcgcaacgagatcgaagaagtggtcgagcgtgccgccgagatgcactggagctacgacggcaactattacttcctgtccaacaactgcgccgtggaaagcctgaagctgctgcgcagcggcagcaacaatgcccagctcaccgggctcgacagcatcatgcccaacggcctgctggaagtgctcaagggccgcggcctggccgacaccagcgtactggacgatcctcgcgaagccttgcgcctggggtatcgcttcgactccttccgcgaccgctaccaggcgatgttcgaggtgttgaaaaaacacctgccgatcaaacagagcagcgtcgaagactggctgtccctgagcgctgcggagcgtcgccagtggttcgaccaggcggacctgcgcaccagcgctgccttgctgctgctcgaacaggcgagcttccggcgccagctgttgctggcccaggatgaggtcaagcagcgttatctgggggctcgcgagctgcagaacggcggcatggacaaggccaacaagaccctgcaggaaatcctcgccaacagtggcttcctcagtcgcccggccgaattgctcggtagcagcggttatggcttgccgcagccgagcgaatggcaacgcctggaagcggaaagcagcctgcgccagaaacagctgcaggccctgaccggcgatctggacaaggaagtgcgcgcgttgctggaaccgagccgcgctgccgaaatcgccgccaacgaggccaacctgaaacagctcggcgaacatctgcgggccttgcacaaggcggcgggcgggctggaactgccctgatcccgcatcgcgggccagcttccttcatcgctggcccgcgatgcgatcccacaaccttacaacgtctcctcggcctctcccggcaactgctcatccaggtgcagccagggcaaacggctgtcggtccagatatgccgctcggccggcgccagctccggatggtccagggtagcgatggtcacatcgatgctgtccgggctcaattgggtgatcagcgccagatgcgcgccgcagttcgggcagaaataccgcgcacaaccgggcgaagagtcgtagcgggccggcgtcccggccagccattggaaagcctggcggggcagggtgatccaagtagtcaccaggccgccgctgacccgtcggcagatcgaacaatggcaatgggcaatatcgcgcagcggcccgctgaactgataacgcagctggccgcaatggcaaccgccggtgtgcaacaggctcatacgaggacctcccagcgactgttccggaaaactcggccaacgggccgatctggttgttttttgaccgcacgtcggctcgcgacgcatccactcattgctttctacaacgaaaggtagctgaaagcttccgcgattaggatcgcctccactgccggcaacagaccggttggccaatgggcgttttgcgcctccaggcccaattaacaacaacaatggtgattctgatgtccgttcgtacccgccttttcgtcccgcttcctccagcccgtcccgcgcttcccgttctgcgctgaccccatccggtttgccattccctagccgcgctacgcctggagtattcccatgctgactttccttggcttcgccatggtcatcaccttcatgttcctgatcatgaccaagcgcctgtccgcgctgatcgccctgatcatcgttcctatcctgttcgcgctgttcggcggcttcgccccgaagatcggcccgatgatgctcgaaggcatcaccaagctggcaccgaccggcgtgatgctgatgttcgccatcctgtatttcgccttgatgatcgactccggcctgttcgacccggccgtgcgcaagatcctcaagctggtcaagggtgacccgctcaaagtctcggtcggtaccgctgtgctcgcgctggtggtgtctctggacggcgacggcgccaccacctacatgatctgcgtggcggccatgctgccgctgtacagccgcatcggcatgagcccgcggatcatggccggcctgatcatcctggccggcggtgtgatgaacatgactccctggggtggcccgaccgcccgtgccgccagtgcgctgcatgtcgacccgtcggatatcttcgtgccgatgatcccggcgatgctggccggcgtagtggcaatcctggcgatcgcctacatgtacggcaagcgcgaacgggcgcgcctgggcgaactgcacctgcagggcgacgagatcgaccacagcgaaatcagcgtttcgcagttcccggacgcccgccgtccaaagctgatctggttcaacggcgccctgaccttcgccctgatgtgtgcactgatcgccggcctgttgccgctgcctgtgctgttcatggtggccttcagtatcgcgatgatcgtcaactacccgtgcctgcaacagcagaaggaccgcgtcgcggcccatgccggcagcgtactggcggtagtcgggctgatcttcgccgccggtatcttcaccggcatcctgtccggtaccggcatggtcgatgccatgtccaagagcctgctggcggtgattccggatgcactgggcccgtacctggcggtgatcaccgcgctggtgagcatgccgttcaccttcttcatgtccaacgacgccttctattacggtgtgttgccagtcctcgccgaggccgccagtcactacggcatcaccgcggtggaaatggcacgtgcctcgatcgtcggccaacccgtccacttgctcagcccgctggtaccatccacctacctgctggtagccctggccggtatcgagttcggcgatcaccagcgcttcaccctcaagtgggcagtgctggtttgcctgtgcataatgttcgccgccttgctgatggggatttttccgctgttcagcactctataaaaagcaattgactcaccgcgccggccgctagacttcgttctcggaaatctcgactggcgcggtacaacactcgctcaaaggaatacacatggaatggctgaccaacccggaaatctgggttgccttctttaccctgaccgccctggaaatcgtcctgggtatcgacaacatcatcatgatctcgatcctggtcagccgcatgcccaagcacatgcaggcacggacccggatcttcggtctggcgctggccatgatcacgcggatcctcctgttgctgtcgatcacctgggtcatgcgcctgaccgccgacctgttcgtggtcttcggccagggtatttccgggcgtgacctgatcctgttcttcggtggcctgttcctgctctggaagagctcccaggagatgtaccactccctggaaggcgaggacgaaaccgcggaagagccaagcggcaagggcggcaacttcctctacaccatcatccagatcgcgatcatcgacatcgtgttctccctggactcggtgatcaccgccgtcggcatggtctcccatgtaccggtcatggtcgcggcgatcatcgtcgcggtgctggtgatgatgctggcttcgggcaccatcagcgagttcatcgacaagcacccgtcgctgaaaatgctggcgctgtcgttcctgctggtggtcggtaccgtactgatcgccgaggcgttcgaagtgcatgtaccaaaaggctacgtctacttcgccatggccttctcgctggcggtggaggcgatcaacatcaagatgcgcaccgccatcgcgaaaaagaaaaagcagcaggacccggtgaaactgcgcaaggacatcccgggtcaataacccgagagcgcagcaggaaaaggggctttcgagcccctttttcacgcctgcgaaaaaccgctttcttcatgacagttttgtttcaatcgccgcatcagctatgcgatgctggcgcacagaccgttagccaactacagcttaagtacagaacgtagaacaacgcgcggcaccgttaacttgcccctctggggcgctattcaccacagggggccgttatgctcaccctgctcaatttgctgtccgccgtggccttgctgatctggggcacgcatatcgtccgcaccggcatcctgcgggtctatggctcgaacctgcgccacctgatcggccagaacatggccaagcgtccgttggctttcatcgccgggatcctggtcaccgccatggtccagagcagcaacgccacggcgatgctggtcacctcgttcgtcggccaggggctgatggccctgacacccgccctggcgaccatgctcggcgccgacgtcggcaccgcgctgatggcccgggtgctgaccttcgacctgtcctggctgtcgccgctgctgatctttctcggggtgatcttcttcctctcgcgcaaacagacccgcgccggccagctcgggcgggtagggatcggcctggggctgatcatcctggccctgcaactgatcgtcgaagccgccgcgcccatcacccatgcccagggcgtgaaagtcctgttcgcctcactgaccggcgacatcctgctcgacgccttgatgggcgcgttgttcgccatgatttcctactccagcctggcggccgtgctgctcaccgcgaccctggccggggccggcgtgatcagcctgccggtggccatcggcctggtgatcggcgccaacatcggcagcggggtgctggcctttctcagcaccaacatgcagaacgccgccggccgccaggtggcgctgggcagcctgctgtacaagctgatcggcctggtgctgatcattccggtgctcgacccgctcgcccactggatggacagcctggacttcagcccgcaagaagtggtgatcggtttccacctgctctacaacaccctgcgttgcctggtgctgctgccgacggtcgggccgatggcgaaggtctgcacctggttgctgccggaacgcccggaaaccaatggccgggccaagcctcgccacctcgatccgaccgccctggccacccccagcctggccctggccaacgcggcacgggaaaccctgcgcatcggcgacctggtcgaaaccatgctcgaagccgtgcgcgatgtgctgcacggcaagcagaccgcgatcacccaggaaatgcgcaacctcaacgacgatgtcgaagtgctctataacgcgatcaaactctacctagcgcaaatgccccgggaagacctgggcgaacaggacagccggcgctgggccgagatcatcgaactggcgatcaacctgaaactggccagcgacctgatcgaacgcatgctgcgcaaggtccagcagcagaagaccgcgcagcgtcgctccttttccgaagtcggcctggaagaactggccggcctgcatgaacagctgatcgccaacctgcgcctggggctttcggtgtttctcagcgccgacccggaaagcgcccggcagctgctgcgggaaaaacgccgctttcgcgctcaggaacgtcgcctggcccatgcccatgtcagccgtctgcaacgtaaaatcgtccagagcatcgagaccagctcgctgcacctggagctgatcgccgatatgaagcgcttgaattcgctgttctgcggcagcgcctacgtggtgctgggttcctccgaaaccggcgcgctcgccgtggacgatatggctgacatcacccattcaccctgaacgtccagagttactcgaagtctgttgaacttacgcccgtcgtaaggaagcccgttatgcgttgcctgttattcgcctgtctgctgctcggatcagcccattcgtttgccctggatcgcttccaggtcgaaggctacatgctgcccaacggcctgcagttgctgctcaagccgggcaacgtgcgcggccacgtggcgattcgcctggtggtcggggtagggctggacgacttcggctgcgccgacaaggaactgccgcatgtgctcgaacacctgctgttcagcggcatcgacgccagcggtgagggcgggctggaggaacgcatgcaagctctgggcggcgagtggaatgcctacaccagcaatgccgataccacgttcgtcatcgaggctccggcgaaaaaccagcgcaaggtgctggacctgctgctggccctcttgacccgtaccgagctcgacgacaacgcattgcaaacggcgaaacgggtggtcgagcgcgaggacggcgggcattactcgcacctgcaacgctggctggaccgccaggacctgggccataccgccagtaatcagttggcggtggagctgggcctgaagtgcgccgaacgggccgaggtcgatcaactgaccctggaacagctggagcagctgcgcaagaactggtacgcgccgaacaacatgaccctgatcgtcgtcggcgaccttgaccgcctgctgccggcctacctggaacgcagctacggggcgctggaaccggtggagcccagcgagcaccagggcctgccggacattcaacaaacggccgccgccgagcgcagcctgatccacggctgggtcggcgacagcgccaagctgcactggctgttccccgagccgatcctcgaccggcagcacgatgaaaccttcgatctgctcaaggattacctggactgggcgctgtaccagaagctgcgcctgcaacatgagctgtcctacgggccgaacagcgaacgcgaggtgttcggcggcgtcggctttctcagcctgaatgccgacctggagcgcgcggacgtccccgaggcccggcaagcgatcgacgagctcaaggcgcagctgctcaaggacggcctggagccgaccaccttcgcccgtctgcaacaggccgccattgttcgccaggcctgggcggtacagggcaatagcgccctggcggactactactggagcgccttgagcgactacgcggacgggcgtttcagcgacccggccaagcgcctgcaagccgtcagcctgaagcaggccaaccaggccatgcgccaactgctggaacagcccggctacctgcggatcgaaaaaccgctgctgagctatacggccctgagcgggctgatcggcgcactgctattgattgttttggctctgttcggctggcgggcttatcgcaaacgaatccgtgcctgatgcgtcttttgtcatgctaaaccgttattctgtcggggattttttctagtgtgatcgccgaatgccaaacctgactcattacatgcagcgcatcctggaactgatgaagcgctacccaggggtcattgcgctcggcggtttcatttccggtgtcggcagtttcatcctggtggaccgccaacaaggcctggccacctggatcgccgtgatcatgctggtgagctggatctggctgatgctggaaaacagcctgacccagctgttcaccaagatcttcaagcgggaaatcccccagccgctgctgcgttacgcaacgcagatgattcaccaggaaagcctgtttttcgtcctgccgttcttcttcatcaccaccgcctggaacagcgggcagctggtattcaccggcctgctgggcgcctcggcgctggtctcgatcatcgacccgctgtactacaaatggctggccccacgccgctggctgttcctcgccctgcacaccctgacgctgttcgccgcgttgctgaccgcgctgccgatcatcctgcacctgaccaccgcgcagagcttcaagctggccctgggcatcgccatgctgttgtcgttccccagccttgcgtcgatcttcccgatccgcaacctgcgcggcgcgctgatgctgctgggcatgaccctggccatcggcggcactggctggctgctgcgctcctgggttccgccggcgaccttgtggatcgccgaggaagccatcagcacccagttgcaggaccgcacccccggcgccagcctcaaggaggtcagcgccaacgacgtgcgcagcgccgggctgtatgcctacaccgcgatcaatgcgccgcgcgggctggacgagcgcatttatcacgtctggcaattcaacggtaaagaggtcgaccgggtggccctggacatccacggcgggcgcaaggagggctaccgcgcctggtcgcacaagcagaacttccccggcgatccgaccggcagctggcaggtccgggtgctgaccgaagacgggcaggtgatcggcgtgctgcgcttcaagatcaccggcaccaacgggcaagactcagcaccttagtacaaggcaaagtcgtctcgatcgtggtattacgtagcactgcgtaaaaaccatgcaagcacggagcttatgactcagagcacgacggccggcagtgcccaactggatacgtcgagttccccctcgcggttgcgagtcgcgggggactggacgctcgtccattacaccgagctcaagcacctctgcgaaaagctcaccggacagtacgacgccagcacccacatcgacctcaacggcctcggcgccctggataccgcgggcgcctcgctgttggtcgagctgctgggctccgagcgtctcggccagtccaccgaacaccccgactgcaccttgtcttcggccgaccgcgcgctgctgcagaccgtctactgctcgctgaccgacttctgcgtaccgctcaaggagccggaaatatcggtcggcatccagttgctgacccggatcggcaaggcggtcgacgccatctggcaggacagcctgaagctgctgggcttcgtcggcctgatcctcgaaaccctggcccgcggcctgctgcgccccaagcgctggcgcatcacgccgatggtcgcgcatatcgagcagaccggcctcgacgccgcgcccatcgtcgccttgctgacctttctggtgggcgccgtggtggccttcctcggcgccacggtgctgcagagtttcggcgccagcatctttaccgtggacctggtggcgttctccttcctgcgtgagttcggtgtgctgctcaccgcgatcctcatggccgggcgaaccgcgagcgccttcaccgcgcagatcggctcgatgaaggccaacgaggaaatcgacgccatccgcaccctgggcctggacccgatggagctgctggtgctgccccgggtcctggcgctgctggtggcgctgccgatgctgaccttcctggcgatgctctcggggattgtcggcggcggggtggtctgtgcgctgtcactggatatctcgccggcgatgttcctcgccttgctgcaatcggacatcggcgtgcagcacttcctggtgggcatggtcaaggcgccgatcttcgccttcctgatcgccgccatcggctgcctggaaggcttcaaggtcagcggcagcgccgaatccgtaggcgcccacaccacctccagcgtggtgcaatcgatcttcgtggtgatcgtcctcgatgccgtcgccgcgctgttcttcatggagatgggctggtgaaccgttcaacccgtccgcccgccgaggcggtgatcgaagtccgtggcctgtgcaatcgcttcggcccgcagagcgtgcacgaaaacctcgacctggacctgtacaagggcgagatcctcgcggtggtcggcggttcgggcagcggcaagtcggtgctgctgcgcagcatcatcggcctgcgccagcccagcgcaggttcggtgcgggtcttcggccagaacctgccgagcctggcggaacatgagcgctcgctgatcgaacggcgcttcggcgtgctgttccagaagggtgcgctgttctcgtcgctgaccgtgaccgaaaacgttgccctgccgctgatcgagcatgccggcctgagccgcgccgacgccgagcacctggcggcggtgaaactggcgctggccgggttgccgctgtcggcggccgacaaatacccggcctcgctgtccggcggcatgatcaagcgcgccgccctggcccgggcgctggccctggacccggacatcctgtttctcgacgaacccaccgccggcctcgatccgatcggcgccgcggctttcgaccaattgatcctgaccctgcgtgacgccctgggcctgagcgtgttcctggtcacccacgacctggacacgctgtacaccatcaccgaccgggtggcggtgctggcacagaaaaaggtgctggtggcggatgccatcgaccaggtcgccgagaccgacgacgcctggattcacgagtacttccatggccctcgcggccgcgcggcgtatcaggccgctacacagctcaacgaggtatgacatggaaacccgagcccatcatgtactgatcggcctgttcaccgtgattgtggtggtcggcgccctgctgttcggcctgtggctggccaagtccagcgtcgacacggagttcaaggactacgagatcatcttcaacgaggccgtcagcggcctgtccaaaggcagcgccgtgcagtacagcgggatcaaggtcggcgatgtggtcagcctgcgcctggacccgaacgacccgcgccgggtcctggcgcggatccgcctgagtggcgaaaccccgatcaaggaagatacccaggccaagctgaccctgaccggcatcaccgggacctcgatcatccagctcagcggcggtactccacaaagccagtcgcttctgggcaaggacggcaaactgccggtgatcgtcgcgtcgccatcgccgatcgcccgcctgctgaacaacagcgaagacctgatgaccagcgtcaacctgctgctgcacaacgccaacagcatgttctcgccagagaacgtcgagcgcatcggcaacaccctcgaacacctggagcagaccaccggagccatcgccgaacagcgcggcgacgtacgcctggccatgcagcaactggcgtccatcggcaagcaggccagcgccaccctggaacagaccaccgcgctgatgcgcaacgccaacggcctgctcaacgagcagggcaagcagatgttcggcagcgccgggctggccatgcaatcgctggaacagagcagcgccaccatcaacaaactgctgaccgacaaccaggactcgctgaacaatggcatccagggcctcaatggcctggcgccggccgtgcgtgagctgcgcgataccctgagctcgctgcgggccatttcgcgtcgcctggaagccaaccccagcggctacctgctgggcagtgacaagaacaaggagttcacgccatgaagcgtgcctatcgcccatttggccggctggccctggccgccggattcgccttgagcggcgcctgctcgatcctgccccaggccgacccggtggatatctatcgcctgcccacggcccagagcgccacagcccggcctcagggccacgcgcagccctggtccctgcgcctgaccaaacccctggcgagcgacgccttgaacagcgcgagaatcgctgtgatcccccaaggcgatgtgatcagcagctacaaggacgcgcgctggagcgatccggcgccggttctgctgcgcaatcggctgctggatgggttcctcgccgatggccgggtgcagttgctgggcaccgacgacagcgatgtgcagaccgacctcgaactgggcggcaacctgcaggcattccagagcgaataccagggcaaggcggtggcggtggtgatccgcctggatgcgcgcctggtgcgcggctacgaccagaagatcctggccagccagcgcttcgaagtgcgccagccgctgaacgataccaaggtgccggcggtggtcgccgggtttggccaggccggggacgccttgaaccggcaggtggtggagtggacggtgaagcagggcagtcagctggtcaggcgctgacgacatcatcgagggcaagctcgcgcctacaggatggtcctggtaggagcgaggcttgcccgcgaatcgttccgagccttaaccgaagaaccagtagcacaccgcaatcgccgccaccacgccggccagctcggccagcagggcgcagccgacggcatggcgcgcccgctggataccgactgagccgaagtacaccgccagcacatagaaagtggtctcggtactgccctggatcgtcgccgcggccaacgccgggaaactgtccacgccctgggtctgcatggtttcgatcaacatggcccgcgcggcgctgccggagaagggcttgaccagggccgttggcagggcatcgacgaagcgtgtgtcccagccagcccattccaccagatagcggatgccgtccaggccgaagtccagggcgccggaggcgcgcagcacgcccaccgcgcagagcatggccaccagatacggcagcaggttcttggcgacgtcgaagccttccttggcgccctcgacgaaggcctcgtagaccttgaccttgcgcagcgcgccaatcaccaggaacaacatgatcaggccgaacagggtcaggttgcccaggatcgacgacagcgacgccagcgcggtggccgacagcgtggcgagcaaggccatgaagccgcccagggccagggcgccgggaatcaggtaggccagcaccactgggtcccacaggcgcaagcgctgcatcaccgcgaccgacagcaggccgaccagggtcgaggcgctggtggccagcaggatcggcaggaacaccagggtcgggtcggcggcgccttgctgggcgcggtacatgaagatggtcaccggcaacagggtcagggacgaggcgttcagcaccaggaacaggatctgcgcgttgctcgccgtggtcgcgctggggttgaggtcctgcaaggcgcgcatggccttgaggccgatcggcgtggcggcgttgtccagccccaggccattggccgcgaagttcagggtgatcaggccgatggccgggtggccgggcggcacttccggcatcaggcggctgaacaacgggcccagggccttggccagccagtcgacgatcccggccttttcggcgatccgcaaaaagcccagccacaaggtcagggtgccgaacagcagcaccatcacttccaccgacagcttggccatggcgaagatgctttccaccatcgccgcgaagatcccggcgttaccgccgaccagccactgcgccagcgctgaaacggccgccacgatgaagaagccaagccacaggccattgagcatcagttattcccccaaaagatgcggcgaatgatagcggcgcagacagaaacgacaaaccccggattgaccggggtttgtcgatgatcacggctacagctgtcagcctttggtgacttcaccggccggcagcggctccttgctgcgccagtgcggcagggaattccagtagcgctggcccttggcgtcgtcgtacatgccttcccaacgcgcgatgaccaggaccgccagggcgttgccgatcacgttcagcgcggtacgggccatgtccatgatgcggtcgacaccggcgatgaaggccaggccttccagcggaatgcccacgctgcccagggtcgccagcagcaccacgaaggacacgcccggtacgccggcgatgcctttggaggtgaccatcagggtcaggaccagcagcagttgctggctgatcgacaggtcgatgccgtacagctgggcgatgaagatcgccgcgatgctctggtacagggtcgaaccgtcgaggttgaacgagtaaccggtcggtaccacgaagctgcagatggctttcggcgcgccgtaggcttccatcttctcgatcacccgcggcagcacggtttccgaactggcggtggagtaggccagcaccagctcatccttgaagatgcgcatcagcttgatcaccgagaagccgaacaggcgagcgatcaggcccaggaccacgaaagcgaagaaggcgatggccacataaaccaggatcaccagcttggccagcggcagcagggaggcgaaaccgaagttggccacggtcaccgcgatcagggcgaatacgccgatcggggcgtagttcatgatcatgtgggtgactttgaacatgctttccgagacgccctggaacatcttcaccagcggctcgcgcaggtcggcctgcaggctcgacagaccgagaccgaacagcaccgagaagaagatgatcggcagcatctcaccgcgggccatggccgcgaagatgttcgatgggatcaggttgaggatggtttcgatgaacgcgtgttcatgctgtacctcggcggcggtcgcctggtacttggaaatatccacggtacccagggtgctcatgtcgataccggcgcccgggtggaacacgttggccagcaccaggccgaccaggatcgcgatggtggtgacgatttcgaagtagatgatggtcttcaggccgatacgcccgagcttcttcgcgtcgcccacgccggcgataccgacgatcagcgaggagatcacgatcgggatcacgatcatcttgatcaagcggataaagatatcgcccgcaggttgcaggacgttgctgatccaccaggctttttcggcactgaaatggttgagcagcgcaccaattgcaatccccagcaccagaccgatgaggatctgccaggcgaggcttagttttgccttcttcatatcattacccttacttcagttggactcgggctgatgcgcgaactggaacgctcaatggcggaaaagtctgtgcatcggcccccgtataaggtcaccccgagcgagcatttacggctctctgcaggcgaaaaaaggcgcaactattccgacgcaaggggggcgcgtctaatgccgtaaacgcctaccccatgccgaatcggcatgagtttttctaaacgaaacgggcgtcccaaccggttcgaatgtgacatttcggcccgaccatctgccgtgaaacggccatttcaggcggcattcagcgcttttgggcgggttcggaatgaccctcgaaagaagggaaagttcttacgttagaaccagaaatctcatctggaaaaagccaaaagtttctcgatgtacggtcgcaaggaaacaccgtgaaacggttagaccaggcaactcggaatatttgtcgcgaacccctgcctgaaaaagcaggccaccgctctgccacaaaggtttgtggcattcaaacacgacgcaagtcgtcaagcctgagcggctggcgaacttgcgccgcagtttttcctgacccggccctcgcggaggcactccctgtacccctaggtcactccgatccggttgcgatcagaacgtcccggccccctggtcatgcgcggcccctcctcggggcggtgcaacggaaagcaaggctcggatgggcgcttgctttccatggtcgaaccttcgaacagtcaactcagtaccagttcgggtcctttttcagctgttccttgagcaagccctgcatgccagcgtccggcttgccgagaaagcggtattcggcatggcgggtcggcgacttgtccgcgggtaggcccgccggcacttcgaccaacatggcgtaggcgtccttcttgtcgaaactgaatgccacgatcaggcgctggttgcgacaggtatcgcgggtttcgcaaagcggaccgaccaggtacttgtcgccgtcttcttctaccgcattcatctgttgcgcgtcaccggacaggttcatcacccattccggcaggcgctcttccttttcgacgacttcctgccaggtttcacggtattgcgggtcactgttcaacaactcgttgacccgggtctgaccgtcgttggctgccatcgccgtggccgcgccgcccagcaacagggcggcggccaatgttttcaaagaaacgctcatgctcaacctcgaccacgacggccaaagaagaaggaaacgatgaacatcaccaggaaaacgacaaagagaatcttggcgatacccgtggcggtgcccgcgataccaccaaagcccagtaccgcggcgatgatggcaatgatcaggaatgtgattgcccagctcaacatggtcattctccttacgcttctatttagaggtactgcctagccggcccgccgttgcgcaccgactgtcctgcctagaacacccagcgctcctgataagccgtgtcggtggcaggctgagcctggtcgacgtccatcagaagcatcggggcggaatcggcaaaccgagtgctgactgcactgaagtgggtttgagtggggtgagaaaccggcaacctcacagcttcttgctgctgactttgctcccaacgtgaaaactgctgaccgccaatcaaggtcaccagcaatgccaggctggcgaacaatccctgctgcagatgcagggacgaaacagacaatggggcgagacgttggcgtttcatccggaagctcctcccatgggggtcattgttctcaacgcttgttgctgtgcctgcggcttgttcaaccgagcctgatcaggttgttgcagcctgcatgccagctttcatgattaaaacaaactcaataaaaacaattacttgcaataagattgggaggttttccatacgccatcctgcacgatgccgccctggataccgtgcgaattgcacgatcgacccggtacttgaggaaaaaagtgcagctgaaaatgcatggagtacagtggcgaaatcgggaaaggcctgcgggcaagacctaaaatcaataaaaaccctattgttttcaaccgattagcaatagagccaggagataactaatctgcacgccgtgaaatcgatcagaattaaccatgcaacttgcccgatttttccgggactaaataagatcactcacttcaggagcctcggacatggaatcagcaccggaaaatcaaggccgcattcttctggtagatgatgagtccgcgatccttcgtaccttccgttactgcctggaagacgagggctacaccgtcgccacggccaatagcgccgctcaggccgataccttgctgcaacgccaggtgttcgacctgtgtttcctcgacctgcgcctgggcgaggacaacggcctggacgtactggcccagatgcgcatccaggccccctggatgcgggtggtcatcgtcaccgcccattcggccgtcgataccgcggtggacgccatccaggccggcgccgccgactatctggtcaagccctgcagccccgatcaactgcgcctggcgaccgccaagcagctggaagtccgccagctctcggcacgcctggaggccctcgaaggcgaagtgcgcaaacccaaggacggcctggattcgcacagcccggcgatgaaagtggtgctggaaaccgcccgccaggtcgccggcaccgacgccaacatcctgatcctcggcgagtccggcaccggcaaaggcgagctggcccgggccattcatggctggagcaagcgcgccaggaaatcctgcgtcaccatcaactgcccgtcgctgaacgccgagctgatggagagcgaactgttcggtcacagccgcggggcctttaccggcgccagcgaaagcacccttggccgggtcaaccaggctgacggcggcacgctgttcctcgacgagatcggcgacttcccgctgaccctgcaacccaagttgctgcggttcatccaggacaaggaatacgagcgggtcggcgacccggtgacccgccgcgccgacgtgcgcatcctcgccgcgaccaacctcaacctcgaggacatggtgcgcgacggacgctttcgtgaagacctgctgtaccgcctgaacgtgatcaccctgcacctgccgccgctgcgcgagcgcagcgaagacatcctgaccctggccgaccgtttcctggcgcgcttcgtcaaggaatacgcccgtcccgcccgtggcttcagcgacgaggcccgcgaagcgctgctcaactaccgctggccgggcaatatccgcgagctgcgcaacgtggtggaacgcgccagcatcatctgtccccaggaaaaggtggagatcagccacctgggcatggccgagcaaccgaccaacaacaccccgcgcatcggcgctgccttgagcctggacgagctggagaaagcccatatcggcgccgtgctggccaccagcgataccctcgaccaggccgccaagacgctcggcatcgacgcctcgacgctgtaccgcaaacgcaaacagtacaacctgtgagccgcccctcatgaagttagcgatgaaactgcgcacgagactgtttctgagcatctcggcgctgatcaccgtggcgctgctcggcctgctgctcgggctggtcagcgtgatgcaaatggccaagacccaggaagcgctgatccgcaacaacttcattaccctggatctggggctcaagctgcgacagaccctgggcgaccaactgctcatcatgctcaaccacaaccctgaccggacggcgctggacgactccaggcaggaatacctggccctgctcgagcagggcatcgagcatgaacggcaaaacaatgtgcgtaacggcttcacccaggcacgcgacgactaccagcgtttcttcgaagccttcgagcgcgccgacggaaccccggcaggggtcaatggcaataccgaactgacccaccgcttcaataccctgcgcaatggcttgatcggcgagcacaagcaggccctggacaacatcaatgacatcgagcaccaggcccgcaatcgcgccctgctgatcgccggcctgctcggcctggtcgggctggccgtgctgatcatcggcttcatcaccgcccacggcatcgcccggcgctttggcggccccatcgaagcgctggccaaggccgccgacaatatcggccagggcaacttcgacgtgaccctgcccctgtctgcggctgccgagatgaacttgctgacccggcgcttcggaatcatggcccaagccctgcgcgagcatcaggccaccaatatcgacgaactgctcgccggccagcagcgcctgcaatcggtgctcgacagcatcgacgacggtttgctgatgatcgaccgccagggtcacctggaacacctcaacccggtagcccaacgccagctgggctgggacgaggaacgcctcggacaagggctgggcagcgccctgcagcgaccggaactggacgagcaactgcaactggtattgcgcggcggcaccctggaacgggcgccggaagacctcagcgtcgaggtcgatggcgaatcgcgcctgctgacgtacagcctgaccccggtcagccatccccaggggcatatcctcggcgcggtgatggtgctgcacgacgtcaccgagcagcgagccttcgagcgtgtgcgcagcgagttcgtattgcgtgcctcccatgaattgcgcaccccggtcaccggcatgcacatggcgttcggcctgttgcaggaacgcctgcgcttcccggaggagtcccgcgaagccgacctgctgaacaccgtcaacgaagaaatgcagcgcctgatgcaactgatcaacgacctgctgaacttctcgcgttatcaaaacggcctgcagaaactcaccctggcgccttgcaccctggaagagctgctggagcaggcgcgcaaccgcttcatcggcgccgccacggcgcaaggcatcgagctgcgggtggagctccaggcgccgttgccgcggctgcacgccgaccgcatacaactggagcgggtgctggacaacctgatcgacaatgccctgcggcataccgccaagggtggcttgatccgcttgcaggcccgtcggcatggcgagcgggtcatcatcagcgtcgaagacaacggcgaaggcatcgcctacgggcaacagggaaggattttcgaacctttcgtccaggtcggacgcaagaaaggcggggccggcctgggcctggcgctgtgcaaggaaatcgtgcaactgcacggcgggcgcatgggcgtctattcacggcccgggcagggaacccagttctatctggccttgcccctctaggggctaggccccgtcatccaggcgccgcggccccaggcggcgcccgcgggtaatcaggtcgatgaactgcaccgcactcagcgcatgggcgaacagccagccctggccaaaacgcacaccctcgctgctcagcagcaacgcctgatcctcgaactcgatgccctcggcaatcaccttgagctgcagggcatgggccatgcgaatgatgtgcggggcgacgccgctgctggcggcgtcatgccccagggcatcgatgaatgccttgtcgatcttcaggtaatccaccggcagggtctgcaggtacgccaggctgcaataacccgtgccgaagtcgtcgatcagcacctgatggccaacgtcccgcaaggcttgcaggttatgccgggcgaccaccacatcgatcagcccgcgctcggtgacttcgaaggcgatctgccgcgccgccacccgatgcagcgccaacaggcgcgccatcaccttgccgatccgcggcaccatgacatcgcaggccgccaggttgaccgagatgtacagctgcgggttggcccgcaacagatgccccaactgttcgagcaggcgttgcaggacaaaatcggtgatcgggcggatctgcccggtgttctccgccatgggaatgaacaggtccgggctggtcagggtgccgtccggacgacgccagcgcagcagggcctcggcgccgacacactggcgcgttcgcagatcgaagatgggttgatacagcacctgcagctcgccgcggcgcagcgccccctgcaattcggcacccagggattggcgctgcccggccagttgaaaggccaggccgccaataaagaccgccagcaccaggctgctgggcagcagccaccaccacccctcgaaaatttctcgctgcatgttggtgcggggggtgacgagcaccatctgatactccggattgctggtgggcatccggtagatcaactggtcctgggtcaccagcaacgggctgcgtcccgtgggcggccacggttcggtcggcggccagtccagcgccggtcccagcaccgggatggcccgcgagccatggtcgagaaccaccatcaggctgctgttggcgggcaggtcgaccatatcggtcaggtgcccgcgagacgtcgccacgcggaagttgccgcgcccgagcatcagggccgcgcggttttcattgggttcggcggaagtgttcagccagtagctgtaggtcgggccgcggatatccggcggccgcatcacggccaggtcgtcctggagcggccagttggtgcaggcctgggctgcatcgatataggccgcttcataaatgaagcgataactgaagctgatctgctgcagggccacgaccatctcggggctgcatccgcgcaggggctgcgcctcgagtacgtccaggccttcacgcaactgaccgaacagttgctccaggcgttcgagaaaacgctggccctgggcattcatctgctcgctttcgcgtagttgcgcctcgtgcatcgcaatgcccaggctcgccgccagcagcagggccgcactcaacacagccgcacacatcgccaacagccaggggcgatagaaccaactgcgtaggggttcgcgagcggccggcatcattggatatccgagggttaccaatgagttatagctactgattgagaaaaaaccctgaccgtcgggcgggcgtcattattttgtctggttgagcacctgcaggatcgcagcgctttctgcatccggctggccgtcgaaacgcgacggccggtaatgcatctggaacgcggccagcacgtgacgggtcgccacatccagttcgccggtctgcggcgtctcatagcccaggcgagccagctcttgctggaaccaggcgatgctcggcagcgacgcggcaaagaacgcctgctggcgcgccaccgcctgggcgttcggccaccggcccaacccggcttcggccagacgcttccaggggaacagcggacccgggtcgagcttgcgcaggggagcgatatcactgtggccgataatgtgctgtggcgcgatgttgttgcgcttgctgatgtccttgagcagcacgatcaggctctggacctgcgcttcgctgtagggataccagacacgcccggtgggcaggtcgcgaaagcccgggttgacgatctcgatcccgatggagctggagttcagccaggtacggccttgccactggctctcgccggcgtgccaggcgcggtattgctcgtccaccagtttgtagatggtcgccgccttatcgtcgccaatcaggtagtggctgctgacctggccatgggtcagcagttgcagggagcgctccatcgaggccgaggtgtaatgcaccaccacgaattgcacccgctcatcgaagttgaccgaagggtggctggtatcgaaacgcggaccgctggcgcaaccggccagcaacagaagggacaaggcgaggacaagaactttcatggcggaaggcagtacgctggagaaaataatgcaacagtgtaacgtactgcctttgcggaaaaccggcgaaaacaccggtttatacaaaatggaacaaattatgcgtcagcccagttccacccggttgcgccccgcctccttggcccgatagagcgcctgatcagctctcttgagcaccagatcgctgcgttctcccggcttgaaggcactcatgccgatggacatggtgatggtcacccgctcgcccttgaagtgaaacggacaggcttcgatggccgcccgcagggtttccgccaggcgtgccccgaccggccatgtggtatcgggtatcagcaggacgaactcttcaccgccgaagcgggcgatgaaatcgttgccgcgcaggcgcttgcgcagcacgccggcgatgatcttcagcaccttgtcgccggccaagtgaccgtagttgtcgttgatgcgcttgaagtggtcgaggtcgagcatcgccagcaacaaagtgttgccgtgctgctgccactgcgccacttcatgctccagacgctcgctccaggccgcccgattgggcaggccggtgaggggatcgatcagcgctttctgccgctgttcttccagatgctcgcggtagccctgggcttcctgctccatgctcgacacccgctcggccaggctttgcaggcgcgcagccacttccttttcgcgttcgtcacgctgcttctggtgatggtccatggtgccaagcaggccttccaggtggctttccagcacctgcttgagatcgtccagatccgccgcttcctgaacgctgctttgcaggccatcgacctgctcgcgaatctgcgtgtccatctcccgcgccgccgagctgctgtcggcgtgaccttcgctggcggcctgcaggttgctctggaaggattccaggcgctcgttgagtcgcttgagatacgcctcgaattcatgctggccgctgtcggtgatcgccagcatcaatactgccagatcgtcgaggatcggcagcaattcgtaccagttcaatccatgttgcaagcgatcgcgcatggactcggcttgcggccgatgacgttctggcaggctcaggtcatccagaaggccgagcagggtatgttcgatgtgcttggccaccgaactgtaggagggctccggcgtgtcgggcagggcatacagcacatcctgctcggcctgctgcgggtcgatcgccgccagcgcctcggccatggccgccggcaacggcaagcgatcgagcagcacaggcgccggggccggggccgcctcggcgggtgcggcaacgatcaattcgtccgggttggaaagagcaaccgcagcctcgacagtcgaaggctgcacggccggcggcacttcaatgggttcaggcgcggctggcgacggcgattcctgggagtccagcagcggcggagccggctcgacggcgatgggtttctccgactccagcaccggcggtacaaaggcctcgacctgggcagccgtggttacctcgggcagtgcttgcggttgtggctcgggcggcaggctgacagcagcgagctcctcgaccacaggtgcaggcacaggggcttcggacggccgggcggacgcggcttcgacacgaggcgggggcgtttcaaccgcagctctttcaaccgttgccagtggctgtaccgcaaccgggctcgccaccaccgcaggcatttcggccgcggacagggcaggcgattcgtcagcgtcacgaccaccaaacagacgctgcagcaaacctgggcggggcggctccgcggggctctccagctggctcagcgccttgccttgcaggccgctcagttcacccagcaacagtggaatttcccgggcttgcccgacgcgaccatccagttgcttggcgaagtttttcagcggacggctcacctcgcgaggcaacggcagcttctgcaactggctgaccagcgaggtcagggccgtgctcatttgctcgatgcgggtctcgcggcgctgctcggagtccagcacggctttttccaggcgcggcaacagggccgccagggccgcgtccatatcgtcggtgcgcaccacctcgcgcatttccttcatgcactggtcgacagcgcgatcagtaccttcggccgccagcgtgctgcgcaccaggccacggcgaagcaggtcgaggcgggcattccagcgtcgctcgagtttttcctgttgttcgatacttttgaggtacttctctttccagcgctgggcgtcgtcgctcattcatgggttccgcgaggggcaggactcagcgcgggcaatgcatcggccgtgagcgaacccggcagacgaatctctaccgcgaccggcaggtgatcggaaatcggttgggccaggacttcgacccgctccagcgtcaggctggggctgagcaaaatatgatcaagacagcgttgcgggcgccagctgggaaaagtcgcttccaattgcggcgccagcaggccgaggtcgcgcaacggagagtgttccagcagatcgctggcatgggtattcatgtcgcccatcagcacctgatgcttgtagccgccaatcatctcgcggatgtaggccagttgccgggtacgcgtacgggcgcccagggccaggtgcatcatcaccaccaccaacgcctcgggaccatcgccgaagcgtaaaagaatcgcaccacggcccttggggccaggcagcggatgatcttcgatcgcccagggacgcaggcggctgagcacgccattgctgtgctgggccaggcgaccgaggttgcgattgagctgttggtaccagtaggggaaggcgccgagctgggccaggtgctcgacctgattgacgtagcccgagcgcaggctgccgccatcggcttcctgcagggcgaccagatcgaagtcgcccagcagatcgccgatcctttgcaggttgtcggcgcgcccgttgtgcggcaacaggtgctgccagccacgggtcaggtaatgccgataacgttcggtactgataccgacctggatattaaaactgagcaaccgcagacggctgtctgccggcaggccggaggacgccacatggtgctcgttgacccgcggatcatgcaggccaacgatgcgctccgtaccccaacgtcgcatggcaggggcccgcttacttggccgcccgctctttggcgatcagctggtcggcgacgctcagggcaccttcagggccaccggcggtgcccaggtcgaagcggtacttgccgttgacgaccatggtcggtacgccagagatctgataggcctgggccttcttcttcgcgtcctcgaccttgcctttgacggcgaacgagttgtaggtgctcaggaatttgtccttgtcgacgccttcgccggccaggaactcggccatttcctctggggatgcgagtttcttgccgccatggatggcttcgaataccgctttgtggaccttgtgctcgacacccatggcttccagggtgatgaacagttggccgtgaacgttccagataccgccgaacatggcagggatgcgcacgaagttgacgtcggccggcagtttttcagcccatgggttgatggtcggctcgaaggcatagcagtgtgggcagccataccagaacagctcgaccacttcgatcttgccaggcaccgcaaccggaacggcgctgctcagctctacatattgtttaccggcttcaaggggctcggcggcttgagcagtcatgccaaacaggctggcggtgacgagagcggcgctgagaatcagattacgcatgctttactcctgaacaagtaaggtcgcctcgcgcggcctgttcgcagacaggtcatggcagggcttgagttcgctagtgtagcggcagacgccataaaaaagggcagcctgagccaccctttatgctttcatcgacagattaatcgatcattaacgttgcgcaagatagaccctttcgcaacatgatcgccggcctcagtgcaggccctggatgtagctggataccgcttcgatgtccttgttgctcagcttggcggcgatgctgcgcatgatcatggtgtcgccgtcgttggtgcggttgccttcgcggaagtcggtcaactgcttggctacgtactgagcatgctggccacccaggtgcgggaagccggcggcggcgttacccgtgccatttggcgagtggcaaccggtgcaggaaggcatgccttgatccagcttgccgccacggaacaactcttcaccgcgagccacgactttcgggtctgccgcgccgacgctgcctttctggctggcgaagtaggcggagaggtcggccaggtcctggtcgctcaggttggtcagcaggccggtcatttccaacacctggcgcttgccggacttgatgtcgtgcaactgcttgttcaggtaacgctcaccctgacccgccagctttggaaagttaggcgccatgctgttcccatccggaccatggcaagcaccacatacggcggctttcgcctgaccggcagcagcgtcgcctgcagcatgggcgacacctgtgatgcccaaggtcaacagcagactcacgagtaatttgttcatcagctaatccaactacggctaagggttaagagttatggaccgggatcactcgctcatccaaaggatgatggctcggtaatcctcggcactgcagtccatgcacaaaccacgcggcggcatcgccttgaaaccctgggtcacgtgttgcaccagcgtctccataccttgcgccagcctcggcgcccaagctccctggtcccccttgcggggagccgttggtagttggccggaatgacaagccccacaaacacggttgtacacagcttccggatcctgtgtagcctgagcgctgtaaagcggtatcaggacgccggcagccagcagccatttcgtcataaaacgaccttttcagggttgagagcgtgctgcgttctaatgcgcaatcaaggtctatcgctctcgtgaacttcatcctacgctgggacaaagcgcacacaaaatctgcggcattatatactggcgttactgaaacggaaacgacaccgctcgccgcgtccattctcggcaccgcccctatcggaaatcccatgcaactcaaaaatcccattcttggtctgtgccaacagtccactttcatgctcagcgccgccaaagtcgatcaatgccccgacgacgaaggcttcgaagtagccttcgccgggcgttccaacgccggcaaatccagcgccctgaataccctgacccatgccagcctggcacgcacctcgaaaactccgggccgcacgcagctgttgaacttcttcaagctagacgacgatcgccgtctggtcgacctgccgggttacggttacgcgaaagtaccgatcccgctcaagcagcactggcagcgtcacctggaagcctacctgggcagccgcgagagcttgaaagggttgattctgatgatggacatccgccatccgatgaccgacttcgacctgctgatgctcgactgggccgtcgccagcggcatgccgatgcacatcctgctgaccaaggccgacaaactgacctacggcgcggccaagaacaccctgctcaaggtgcagtcgcaaatccgtaagggctggggcgataacgtcaccatccaactgttctcggcaccaaaacgcatgggcctggaagaggcctacactgtactggcgggctggatggaactggcggacaaaggcgccgaaaccgaggcctgaaagacatacgcaaaactgcctgaggtgtgatcaggcaaggcaaaaactggcgggaacggctgaggtcgcattcgactttaggggcctaaatgagcatttcccgccagtttttaacgcagcatgatcgcgccacaggcagttttggggcaaaaaaaaccccggacttcgtatggggaggggaagttcggggtccaagttccggaccgctagggcggggtccagatatctgccaacacttaacacaacataggagcatcgaagggcttcaccagccattcagttactctgagtgggctttcacggattaagttccgggaggtttcaaaaactattggcaatagtcgatgaaattttccgcactaatagctcttcgctagccttcgccgcggcactgtgccgcggccaaagtactgccttctcgcctcagtgcgcctcatcccagttgctgcccaccccgacttcgaccagcagcggtacatccagggtcgcggccttgctcatgtagccgcgaatctcctcgctcaccttgtccaccaggtcttcgcgcacttccagcaccagttcgtcgtgcacttgcaggatgaccttggcatccaggcctgaggccgtcagccagttgtctaccgccaccatggccttcttgatgatgtcggccgccgtgccctgcatcggtgcgttgatcgccgtacgttcggcaccggcgcgttcctgcggcttgttggagttgatctccggcaggtacaggcggcggccgaacagggtttccacataaccctgttccgcggcctgggcgcgggtgcggtccatgtattcgcgcacgccggggtagcgggcgaagtaggtgtcgatgtaggccttggcagtcttggtatcgacgccgatgtccttgccgagcttctgcgcgcccatgccatagatcaggccgaagttgatcgccttggcgctgcggcgctgatcggaactgacgtccttgagttcgaccttgaacacttcggccgcagtggccgtgtgcacgtcgaggttattgcggaaggcattcatcagcccttcgtcgcgggacaggtgcgccatgatccgcagttcgatctgcgaatagtccgccgccagcagcttgtagccaggcggcgcgatgaaagcctggcggatgcgtcggccttcggcggtacgcaccgggatgttctgcaggttcggatcgctggaagacaaacgcccggtagacgcgactgcctgatggtaggaggtgtggatccgcccggtacgcgggttgatctgctccggcaggcggtcggtgtaggtgctcttgagcttgctcatggagcggtactgcatcagcaccttgggcagcgggtagtcgtcctctgccagcttggccagcacttcttcagcggtggacggctggcctttggcagtcttcttcagcaccggcaggccgagcttgtcgtagaggatgactcccagttgcttgggcgaacccaggttgaattcttcgccagcgatctcgaaggcttcacgctccagcgccaccatcttgtcgcccagttcgatgctctgcacgcccagcaggtcggcgtccaccaaggcaccctggcgctcgatccgcgccagcaccggcaccacgggcatttcgatatcgctgagcacgctggccaggctcgggatcgcggccagtttttcatgcaagacctgatgcaggcgcagggtcacatcggcgtcttccgccgcataaggcccggcctgctcaagagcaatctggtcgaaggtcagctgcttggcgcccttgccggcgatgtcctggaagctcacggtggtatggcccaggtatttctccgccaggctgtccatgtcatgccgggtggcggtggagttgagcacataggactcgagcatggtgtcgaaggcgacaccgcgcaccgtgatgccgttggcctgatcgccgccgatggcgcagttggccaggatattcatgtcgaacttggcgtgctggccgaccttgagtttgttcgggtcttcgagaatcggcttcagggcgcgcaggacggtgtcgcgatccagctgctccggcacgtcgaggtaggagtgggtcagcggaatataagccgcttcgttggcctgcacggcgaaggacagccccacgagctgcgcctgctgggcgtcgatgccggtggtttcggtatcgaaggcgagcagcttggcgttcttcagtttttccagccagacatcgaagcgcgcctgatcgaggatggtttcgtactgggcttcgacaaccaccggcacttcgacctcgacctgagtcaacaagtcggccaccgactcggaggcggcgacactcagctccaggcgcttggcatcgcgctgcagctcgtcgagccagctcttgaactccagcaagctgtacagctcgaccagtttgtcgcggtccggctcgcccaggtgcaggtcgtccaggccgatatccagcggcacatcgaccttgatcgtcgccagctgataggagaggaaagccatctctttgtgctcttcgagcttggctggcagggtcttggccccacgaatcggcaggctcgggacgatatcgagctgtgcatacagctcgttcaggccaccgttgacccccaccagcaggccggaagcagtcttcgggccgatgcccggcacacccgggatgttgtcggaggagtcgcccatcagcgccaggtaatcgatgatctgctcgggagcgacgccgaatttctccttcacgccctccacgtccatgctgctaccggacatggtgttgaccagcgtaatgtgcccatccaccagctgcgccatgtccttgtcgccggtggagatcaccaccggccggtcggccgccgcgctgctgcgggccagggtgccgatcacgtcgtccgcctcgacgccctcgacgcacagcagcggaaagcccagggcgatcacgctggcgtgcagcggttcgatctgcacccgcatatcgtcgggcatgctcgggcgattggccttgtactcggcgtacatgtcatcgcggaaggtcccgcccttggcgtcgaacaccacggcgaacgggctgtccgggtactgcttgcgcagactcttgagcatgttcagcacgcccttgaccgcaccggtcggcatgcctttggaagtggtcagcgggggcagcgcgtggaaggcgcggtacaggtaggacgaaccgtccaccaggacgaggggggcttggctcatgagcaggatcaaccttttcggcgggtccggcgctagaatagcgggaccgttgacgacaaagggacaaggttatcatgcgcacactaaatcgcttgctgctggccagcctgattgcaatcgcgccgatggccgtgattgcggcggaggatgcgccatcggcggatccggaagtaaccattcgcacggaaggcgacaagaccatccaggagtaccgccagaacggtttcctgtacgccatcaaggtcacaccgaaggtcggcaaaccctactttctggtgcgcgccgacggttccgatggcaatttcattcgttctgaccagccggatatgctgattccggcgtggaaaattttcgagtggtaaaccactcctaacttcaaccggcgctggctcgacagcggcgcccgtactggcagtttttaaccatgtctgtgttcactcccctggctcggcccgagctggaaacctttctcgccccttacgggctcggccgcctgcttgacttccaggggattgccgctggtagcgaaaacaccaacttcttcatcagcctggaacagggcgagttcgtcctgaccctggtcgagcgcggcccggtccaggaaatgccgttcttcatcgaactgctggacgtgctgcacgacgccgacctgccggtgccttacgccctgcgcaccaccgacggcgtggccctgcgcgagctggccggcaaaccagcgctgctgcaaccgcgcctggccggcaagcacatcaagcaagccaatgcccagcattgcgcgcaggtcggcgagctgctcgctcacctgcacctggcgaccaaggacaacatgatcaagcgcaagaccgatcgtggcctggactggatgcaggaagaaggctcgcagatgctctcgcatctcgacccgcaggcgcgggacctgctgcagcgagccctggatgaaatcgccgagcagaaggtgaagatcctcgcgctgcctcgggccaatatccacgccgacctgttccgcgacaacgcgatgttcgaaggcacgcacctgaccgggctgatcgacttctacaacgcctgctccgggccgatgctgtatgacgtggcgattgccctgaacgactggtgttccgacgccgacggcctgctcgacggctcgcgcgcccgggccctgctgggcgcctacgcggccctgcgtccgttcaccaccgccgaggccgagctgtggccaaccctgttgcgggtggcctgcgtgcgcttctggctgtcacgcctgatcgccgccgagtccttcgccggacaggacgtgctgattcacgacccgatggagttccagctgcgcctggcccagcgccagcaggtcagcacgccattgccgttcgccatctgaaagcatcgcgggcctcttgtaggagcgcggcttgcccgcgatagcgccagcagtctttacagcgattccaggcaacccgccagatcgttgcccagcttctccagcacctgctcgtacccctgcgcggtggccggggtgtagccgcccagtgcatcgagctccgccagcttcaccggcaagcccgccaccagggtttcggccaggcgcgggcgcaatggcggctcgctgaacacacaggtcttgccgacctgctgcaagcgcgcgcgcattgccgctacgtgctgcgcgcccggctgcacctcggccgccacgctgaacacgcccgcatgcttgaggccataagcgtcttcgaaataatcgaaagcttcatggaagacgaaataaggcttgccggcgattggcgccaggcgggctttcaaacgggcgtccagggcatccaggcgctggtcgaaggccttggcgttgctctggtaacgcgcggcgttagccgggtccgcggcgctcaggtcggccgccatgcggtcggcgatgacccgcgcgttgaccggcgacagccacaggtgcgcatcgaggctgcctggacgatgatcgtggtcatgttcgtcggcttcttcagcatgcgagtggttatcttcggcgaaatgacggagtttcagacctggcaggtcctgcaccgccagcgctggcagcgtgcggcccttgaggacccgcggcaggaagctctccatgtccgggccgatccagtacagcaactccaccgactgcaccttgcgcacgtcggaagggcgcagcgcatagttgtgcggcgaggcccccggcggcagcaggacctcgggcacggcgatgccatcctggacggcggcggcgatcaattgcaggggtttgatgctggtcaggacccggacctcggcctgggccgagctgatcacgaacaaactggcggtaaaagcgacaaaaagggcaaaaagtcgggacacgatgaccactcgaagaggcaagaacgggtaacataataacgtctctcaccattatcgtcgccgctcatgcctaaaaaccccccttgccagtcgcccccacgaccactctcactgcgtacacagcgcactgtccgaggccgatgccctgtgcgcccgccaaggcctgcgcctgaccgccctgcgtcggcgggtgctggaactggtctggcaaagccacaagccactgggtgcctacgacatcctcgccgtgctcagcgaacaggacggtcgccgcgccgcgccgccaacggtgtaccgcgccctggatttcctcctggaaaacggcttggtacatcgcatcgcatcgctcaacgccttcgtcggctgcaatcacccggaacacgcgcaccagggccagttcctgatctgccgcgtctgccacgccgccatcgagcttgaacagaaatccatcagcgacgcgatcatcagcagcgcgcgcgatgtcggcttcgtcgtcgaaggccagaccgtcgaagtggtcggcctctgctcgggttgccagggggcttgatgagcaatgccttgatccgcctcgatcaggtcgcggtgacctttgccgggcagaccgtgctggacaacatccagctcagtgtcgagcctgggcagatcgtcaccctgatcggtcccaacggcgccggcaagaccaccctggtgcgcgccgtgctcggcctgctcaagcccgacagcggcagcgtctggcgcaagccgaagctgcgggtcggctacatgccgcagaagctgcatgtcgatccgacattgccgctgtcggtgctgcgcttcctgcgcctggtgccgggcgtggaccgcgcgacagccctggccgcactgaacgaagtcggcgccgaacaggtgatcgacagcccggtgcagagcatttccggcggcgagatgcagcgcgtgctgctggcccgcgccctgctgcgcgagccggaattgctggtactggacgagccggtacaaggcgtggacgtcgccggccaggccgagctgtacagcctgatcacccgtttgcgcgaccgccacggctgcggcgtgctgatggtctcccacgacctgcacctggtgatgagcaccaccgaccaggtggtctgcctcaatcgccacgtgtgctgctccggccacccggaacaggtcagcggcgacccggccttcgtcgagctgttcggccagaacgcgccgagcctggcgatctatcaccaccatcacgaccacgcccacgacctgcacggttcggtggtcaccggggccgcggccggccacgttcatgttcacggagatagctgcaagcatggctgattttctgttgtacgccctgctcgcaggcctggcgctggcgctggtggcaggtcccctcggatcgttcgtggtctggcggcgcatggcctatttcggcgacaccctgtcccatgccgccttgctcggcgtggccctgggctttctgctggatgtcagcccggcggtggcggtgaccgtcggctgcctgctgctggcggtgctgctggtcaccctgcaacagcgccagccgctggcttccgatacgttgctggggattctcgcccccagcaccctctccctcgggctggtggtactaagcttcatgcatgacgtgcggatcgacctgatggcctatctgttcggcgacctgctggcgatcagccccggcgacctggcgtggattcttggcggcagcgccgcggtcctgctgttactggtagccctgtggcggccgttgctggcgatcaccgtgcacgaggagctggccagggtcgaaggcttgccggtggcgtcgctgcgcctggcgctgatgctgttgatcgcggtggtgatcgcggtggcgatgaagatcgtcggggtgctgctgatcacttcgctgctgatcatcccggcggctgcggcccaacgtcacgcccgctccccggagcagatggcgctgggcgcgagcctgctgggcatactcgcggtctgtggcgggctggcgttgtcgtggttcaaggacacccctgcggggccgtcgatcgtggtcacggcggccgcattgtttctgctgagttttgtcctgccccgtcgaggggtgtagacttgctcgctttttgcgcaattagagagtcgcaggaatgaagccgttcgcctcccgttatctgctccttgtcgcattttccctgctgctgggcgcctgccagagcacgccgccggctgaagtgcccgacgcccgcgccacggccatcgcacagctgcagcaaaatatcgccagcagcgaactggccaccgccgaagaccagttgagcgccttgcaggcccagtcgcccaacgacccgcagctcgagcaataccagcgccagctggccgaagcctacctgcagcgcagccagatcgtgttgcaaaagggtgatgtcaacgccgccgccacggccctgagccgcgcccgcgcgctgatgcccaaggcaccggccctgaccggcggcgtcgatggcgctatcacccaggcccgtaaagccgagctggaaaaagccgaagccgcgctcaaggcagctgaagcccggccgccagccaagctgatcgacccggccgccgagagcaccaccattgcgctgaacctcagcgatatcaagcaactgcgtcggcaactcgatgcgatcgccgccgatgtggtgaattaccagtgcgacgtgagcatccaggcgccacgcaccgaagattatccttggctgaagaccctgctgagcaagcgagtgaaaaagctcgatggcgagttcgacctgcagatcgagcggcagatcctgcgccacatcccggcacagatggtgctgacgccacgcaaaccccaataacaccacctctgtaggagcgagcgggcgtcgatccgacttgcccgcgataaacgctaacgcggtgccaaaccctttcgcacgcaagctgtgctcctacagaagcgtcaaagcatcaggccgggatcgccttggccttcggctcccgctcccagacccggtgatgggcaatcgcgttgaagaacgccttcaacgccttggcatccccgccaacgatcaacccagcatccacttccagcttgagcacatccagcaattgcttggcctcgccctgcaaggcaatcgccttgaggtgcttgtaggcttcgagcaggtaatgcagggccacgccatcgccgctcaaggcctgtaccgacttggcgccacccggcacgaacaccgcgtcgaacgccactgacggcagcccttccatggaagcgtccaccggcagggtcttgccatccgcggtggtcacgggcgccgaggtcgggcccagcaacctggcgtgggcgccttcgacttgcagggcctttttcaaggcgtcgatcgccttgccgtcgaccccgttcgccgccaggatcgccactttgcgggtcttgatatcccccgacagcaggttggcctggctcagggccggcgagtgatcgagggacagctcaggcacgtcgaccgtaccgcgcttgggcaccggcaaacccaggttctgcgcgacccgcctggccagttcgagatcgatattggccaggatctcgttgacctggcgcgcgcggatccactcgcgctcgaccttgcccagctcgaagctgtaggcggcgatgatgtgttcctgctcatgcgtgctcatgctcttgaagaacagtcgcgcctgggagaagtggtcgctgaaggacgggctgcgctggcggatcttgtgcgcgtcgatgcgctcgttgtagctctcgaaaccgccgtcctcggccgcgggcggcgtctctttcggccagccgccatcgatggaattgggctcgtaggacgcccggcccttatcgatggtggtgcggtgcatggcatcgcgctggccgttgtggaagggcgccagcgggcggttgatcggcagctcatggaagttcggcccgccgaggcggctgatctgcgtatcggtgtaggaaaacagccggccctgcagcagcggatcgttggagaagtctatgcccggcacgatatgccccgggcagaaggcaacctgctcggtctcggcgaagaagttgtccgggttgcggttgagcaccatcttgcccaggggcgtgatcggcaccagctcttcggggatcaacttggtcgggtcgaggatgtcgaaatcgaacttgtgctcgttttcctcgacgatcacctgcacgcccagctcccactccggataatcgccgctctcgatcgactcccacaggtcgcggcgatggaagtcggtgtccttgcccgccagcttttgcgcctcgtcccagaccagggaacaggtgcccactgtcggccgccagtggaatttgacgaagctggatgtgccttcggcattgatgaaacgaaaggtgtgcacgccaaagccctgcatgctgcgcaggcttttcggaatcgcccggtcggacatggcccagatcaccatgtgcgccgattccggctgcagcgacacgaagtcccagaaggtgtcgtgggccgagcctccggtggggatctcgttgtgcggctcgggtttgaccgcatggacgaagtcgggaaacttgatcgcgtcctggatgaagaacaccggcatgttgttgcccaccaggtcgaagttgccttcgtcggtgaagaacttcacggcaaaaccgcgcacgtcgcgcacggtgtcgccagagccgcgcggaccctgcaccgtggagaagcgcacgaacactggggtcttcttccccggatcacgcaggaagccggccttggtcagggccgaatgattctcgtaggtctggaagtagccatgggcgccgacgccacgggcatggacgatacgctccggaatccgctcatggtcgaagtgcgtgatcttctcccgcatgatgaagtcttccagcagcgagggcccacgggcgccggccttcagggtgttctggttatcggcgaccttgaccccctggttggtgcgcaacgcctgttcggtggcgtcggagcggaaggtctccaggctgtgcagcttgctgttggtgttgccgcgatccagggtatcggtcccggccagctggcttttcgatgcgcttggcttcttgctactcatcaggcaaaactcctcgttggcgaagccccggcggggcggggcttcatcggtcaaaatcgccaggcacggcacctggcttttttcgagtggcttattgagtgactgatgaggtttggcgccgttccttttttatgacctttgatcgcgttattgccaaatcgaaggatgaatacaaaataaatgctaagaacctctatacggacaggctaaaatgcgcgcccggctaaccgctgatccttttctaacgcgccccacaaggttcgctacgtgatcgagtttcaaaacgtccataaaacctaccgggtcgccggtaaggatattcccgccctgcatccgaccagcctgaaggtcgagaacggccaggtattcggcctgatcggccattccggcgcgggcaaaagtaccctgctgcgcctgatcaaccgcctggaaaaccccagcggcggcaagatcgtcgtcgacgacgaggaagtcaccgccctggacgccaacggcctgcgccgcttccgccagcaggtcgggatgatcttccagcacttcaacctgctggcctccaagaccgtggccgacaacgtcgcactgccgctgaccctggccggcgagctgtcgcgcagcgcgatcgaccagcgcgtggccgagttgctggcccgcgtcggtctttccgatcacgccaagaaatacccagcccagctgtccggcgggcagaagcagcgcgtcggcatcgcccgcgccctggcgaccaagccgaagatcctgctgtgcgacgaagccaccagcgccctggacccgcagaccaccgcgtcggtcctgcaactgctggccgagatcaaccgtgaactgaagctgaccatcgtgctgatcacccatgaaatggacgtgatccgtcgcgtctgcgaccaggtggcggtaatggacgccggggtgattgtcgagcagggctcggtggccgaggtgttcctgcatcccaagcacccgaccaccaagcgtttcgtccaggaagacgagcagatcgacgaaagcgaacagcgcgacgacttcgcccacgtgccagggcgcatcgtgcgcctgaccttccagggcgatgccacctacgcgccgctgctgggcaccgtggcccgcgaaaccggggtggactacagcatcctcgccggccgcatcgaccgcatcaaagacgtcccttacgggcaactgaccctggctatcaccggcggtgacatggaggcggccttcgcccacttcaccgcggcggatgtccacatggaggtgctgcgctaatggaactgctgacaagtttcttcgccaatatcgactggtacgaaatctggctggccaccggcgacaccctgctgatgctcggtggctcgctgctgttcaccgtgctgctgggcctgcccctgggcgtgctgctgttcctctgcagcccgcgccagttgctggagcagaagagcctctacgccctgctgtcgctgctggtgaacatcctgcgctcgctgccgttcatcatcctgctgatcgtgatgatcccgttcaccgtgctgatcaccggcacctcgctgggtgtcgccggcgcgatcccgcccctggtggtcggcgccacgccgttcttcgcccgcctggtggagaccgccctgcgcgaagtggaccgcggcatcatcgaagccacccagtcgatgggcgcgaccacccggcagatcatcaccaacgccctgctgccggaagcccgcccaggtattttcgcggcaataaccgtgacagcgattacccttgtttcctacaccgccatggcgggcgtggtaggcgcgggcggtctcggcgacctggcgatccgcttcggttaccagcgcttccagactgatgtgatggtggtcaccgtggtgctgttgctggtgctggttcaagttctgcaaaccgtcggcgacaagctggtggtgcacttttcccgaaaataagtcggccctggccggcaggcgtccggcaccgggcgcctcacaaggagctagctggatgaaaaaactactcgtcgctttcgccgccgttgccgcgttctccgcgcacgccgctgacaccctgaccgtggccgccactccggtgcctcacgccgagatcctcgaattcgtgaagccggcgctggccaaggaaggcgtggacctgaaggtcaaggtcttcaccgactacatccagccgaacgtgcaggtcgcggaaaagcgcctggacgccaacttcttccagcaccagccgtacctggatgagttcaacaaggccaagggtacccacctggtaaacgtcgccggcgtgcacctggagccgctgggcgcctattccaacaagttcaagaagctcgaagaactgccgggcggcgccaacgtggtgatccccaacgacgccaccaacggcggccgtgccttgctgctgctggccaagaccggcctgatcaagctcaaggattccaacaacatcctgtccacggtcaaagacatcaccgagaacagcaaggacctgaaattccgtgagctggaagctgcgaccatcccgcgcgtgctgacccaggtcgacctggcgctgatcaacaccaactacgccctggaagccaagctggacccgtccaaggacgccctggtgatcgaaggcaaggactcgccttacgtgaacatcctggtggcccgtcctgacgacaaggactcggaggccatgaagaaactggttgccgccctgcacagccccgaggtgaagcaattcattctcgagaagtacaaaggcgccgtggttccggcgttctgatcggttgcagaaacacaaacggggcgccttgaggcgccccgtttcgtttcagttgcctgccgagttccctgtagccgctgccgcaggctgcgatcggctccgcaggagacgtgctcttgaggccctcggaaggcgctaagcgccttatcgcagcctgcggcagcggctacagggttcaggcgtcccggattacttgcgctgcaacatcaccggcagctgggccaccagcttctggttgttcagcggcgcgcggatgaagccgcgctgggtgccgtccgggccgatcaccgccaggttgccgctgtgatcgaccgtgtaattgggcttgctggtgtccgctggaatgaacgggatgctcaccgcgttggcgagtttctgcacgtccgccaccgaagtcgcggtcaggcccttgaagtccttgtcgaagtatcccaggtactgtttcagctgctgcggcgtgtcgcggttcgggtcgacgctgaccagcatcacctgcaggttatccaccgcctccttgggcagctcgctcttgatctggcgcagctgggcgagggtagtcgggcagatgtccgggcagaaggtgtagccgaagaacagcaggctccacttgcccttgagctcattgagcaccaccggctggccttcctggtcggtcatcttcacatccggcagattgcggctctggggcagcaggatgatcccggcgtcgatcaacgcggtcggatccccctggttcttgccggtcagcactttgttgacggtgagccccagcaccagggccaccagcgccacgagaataaagacggttttctgagttcgagtcataggttcaacaataggtagtggtctacgagcagcgcgataaacagcaggaacaagtaataaatagagtacttgaaggtgttgatcgccgcgtgcggccgactgccacggtacagcacccaggcccattgcagaaagcgcgcgcccaggcccagggcacacatcaggtagagcatgccgctcatgtggatcgcataaggcagcaggctgaccgccagcaaggcgcaggtgtagagcaggatatgcaccttggtgtagtgctcgccgtgggtcaccggcagcatcgggatatcggccttggcgtattcctccttgcggtgaatggccagcgcccagaagtgcggcggggtccaggcgaagatgatcagcaccagcagcagcggttcggccgtcacatggccggtggccgcgacccagcccaacagcggcggcgcggccccggccaggccgccgatcacgatgttctgcggggtcgcccgcttgaggaagccggtgtagatcaccgcataaccgagcaacgacgccagggtcagccaggcggtcagcgggttggtaaacgccagcagcaaggcttgcccggcgatggccagcagcagggcgaaacccagcgctgccgccggcgacacccggccttcggccagcggccgtttgtgggtgcgcgccatgactgcatcgatccgtcggtccaccacatggttcaccgccgccgccgcgccggcgcacaaggcgatgcccaggttgccgaacaccagcaccgtccacggcaccccggcgcgagtggcgaggaacatgcccaccagcgaggtgatgagcatcagcaccaccaccttgggcttggtcagttccaggtagtcacgccagatcgcctggctgtgacgctcgccgatcagagtcgccatggcatctctcctttaatggttatgggccctgcggcgtgtttgcgcgggctcaggcgccagcccagcggcaggtgcgagcgggcgcggaccaggctggtgcgggcgtgataattgaccagcaccagggtcagcagcagcgccgcgccgccggcgttatgcgctacggccaccggcagcggcagatggaacagcacattgctgatgccaagggcgatctgcgccgccagcgccaccagcaccagcccggcgaggcgggtcatgcccacatgcttgagttgccaggccaggccgagcaacaccagggtcaccagcagcgcgccgatgcgatgggtcaggtggatggccgtgcgcgcgtcgctgtcgagctgcccgcccaggtagttggggccgatgtgctgggtcaggtgaaagccattggcgaaatccgccgccggccaccactggccgtggcaggtcggcaagtcgatgcaggccaccgccgcgtagttggagctgacccagccgcccagggcgatctgcccgatcaccagcaccagcccggccgtggcccagtattgcaggcgcctgggcacgatcagcgccggcagcaccccggacaggcgtagcgtcagcaagaacagcaggctcagggtggcgaagccgcccagtaggtgcgcggtgacgacttgcggccacaacttgagggtcaccgtccacatgccgaacaaggcctgggcgaacaccaccgagagcaggaacagcggcaacttcagcggttgcccgggatgatgccggtgggtccaggagcgtgccgccagcagcacgatcaacaggcccagggtgccggcgaaatagcggtggatcatctcgttccagcccttgtgggcttccaccggggtgtcgggaaaatgcagttcggcatgggcctgctgggcttcgcttttcggcacgctgatgaaaccgtagcaacccggccagtccgggcagccgaggccggcgtgggtcagccgggtgtacgcgccgagcagcaccacgatcagtgccagcaaggtggcaaacaaggcgaggcgaaatccaggtttggccatgacgatgcccttatccgatgttcgacagtttcagcagatgacgcaggtcgttgagcaggtccttgcccttgacccgggcgtcgtagcgcaggaccaggttgccgtgcgggtcgacgatccacagcagcggcgcgccctggtcgctggcgcccttggtgaaggtcggcaggtccagtgggtagcgttgcagttgcgggtattcgcgttgcagcttggcctggtagtcggcgtccagcggctgggcggcggccagggcgtggctggcgcgggaggcgtcgcggccgagggagatctggatctgccgcgccaggtacaccagttgctggcaatccacagcgcagtccctgggcgcggtgaccaggatctgccagcgcgtctcgtcggcctggaccccgatgtcggcgcggctctggccgttgccaatcagctcgccgtggtagctgcggctttccggtacccagaactgcaacttgtacatgccagtggcgaggatcatcggaccgatcaccatggccacgatcagcagcagctgccagcgtccgcggcgccggttgtggggcacctgggcctcagaaatgttgggtggattcatggccgctcccatggtgtttctcccttgcgttatgccatccgagatagaggtacaaagcgcacagggccagcgccatggcgaaccactgcacggcgtagcccaggtgtttttccggccccatggccaccaccggccattcggtcatgtaggcgcccggaccagcctcctggcgcagctcgtaggcaaaaccgctgcgtcccagttcgctccagagcctggccggatcgatcgtcgtcaccagccgcggccactgggcattcagtgggtcggcgtgcagttgaaaggtcgcgccgggggcgacatagacccaggcgtcgaggctcagggactgttccggggtgctgaatgcgggtggcgtgcgccggtccggccagggcagccagccacggttgagcaacagccattggccgctggcctggtcgagaaagggttgcagcagctcgaccccgaccttgccctcatgcatgcggttatccagcagcaggctatgggccgcatcgaagcgaccgtgtaactgcacccggcggaacgccgggtcaggggcagcctgcaactcatccacggtcaaaggctcggccacccgccgttcggcgtagctggccagcagctcgcgcttgtgttcgccccggcccagttgccagaacccgagcgtcaccagcaccggcagcaacgccagtaccaccagggtcggcagcacgcccgggcgaaaggcgttcatggcaacgcccgaaagtggcgagatcgactggctatactcaagcgcatcgcgtttcccctggagcccaccatgcttaaagcggccatcgtcctgttgctgatcgccacgctcatcagcctgttcagcggcctgttctttctggtcaaggacgacagcagctcccatcgcctggtcaggtcgctgaccgtgcgtgtgtgcctggccgcgctcaccgtcggcttgatcgcctggggtttcttcagcggccagttggtatcgcacgcgccctggtaacgccgcgctcagagcacgtagacgaagacaaacaagccgatccacaccacatcgacaaagtgccaataccaactggccgcctcgaaaccgaactgatgctcggcgtcgaagtggcccttcatgatgcgcatcagcatcacgaacagaatcaccgtacccatggtcacgtgggcgccatggaacccggtgagcatgaagaacgtggcgccgtagatgcccgaacccagggtcagccccagctcgtggtaggcgtgcaggtactcctcggcctggaagccgagaaacgcacagcccagcagcacggtgatcgccagccagattttcagcgcgccgcggtggccattcttaagggcatggtgggcgatggtcacggtgacgctggaactcaccagcagcacggtgttaagcagcggcaggccccaggggctgatgacttccttgggcggcgggaacagcttggaatcggggttttcgagcaatggccagacgaactcgaagttcggccagagcatgtgcgcgatgcccttgctgccttcgccacccagggccgggccggcgatctggcgcacgtagaacagcgcgccgaagaaggcgatgaagaacatcacttcggaaaagatgaaccagctcatgccccagcggaacgagcgatccagctgggcgctgtacaggccggcgcgactttccttgatcaccgcgccaaaccagccgaacagcatgtaggccagcaacaggctaccgacgaagaaaatcagcgggccatgggattccgggcgcgcggccttgaggtcgttgaaccaggtggccaggccgaacaccgtaacgaacatgcccaccgtggcgatgatcggccacttgctctgggcgggaacgtaataatgctcatgagttgccatttattgttctccttatcgggcaccgtcttaaccgccggtgttggtgctcacggccaccggtggatgacgcgcggtgatatcgaacagcgtgtaagccagcgtcaggtgcttcacatccttgggcatgtcgcgatcaacgatgaaacgtaccggcatctcgatctgctgaccgggctgcagcacttgctgggtgaaacagaagcattcggtcttgtggaaatacatcgcggcgctgctcggcgaaatgctcgggatcgcctgggcgctcatcggacggtcgctggggttgcgggcgatgaagatcatctcgttcaccgcgccaggatgaaccacgatgtcgtcggccttgggatagaagtcccagaccatgtcgatcgcgttggtcgacaggaactgcacgcgcacctggcgcgagacatccacttgctgctcgccggaatactgcccgccggtcttgccgttgatgcccagcgccttgcacatcacgtcgtagatcggcaccagggcaaaaccgaagacgaacatcgccgccaccaccagcaacaggcgggtgaccagcgtcttcatcgagatctcagccatgagcgcgccccctgtaggagcagccggtcgacgctcgattgctcgcgaaaaaatcaccaacgatgacacgatgtggctgatggaacgccacttcgtggctatcgcgagcaagctcgctcctacaggaggagatcagttggcagcgcggcaggctattcatttcacttccggtggcgtggtgaaggtgtggtacggcgccggcgacggcacgctccactccagcccttcggcaccgtcccagggcttggccggcgcgggttggccgccacggatgcacttgatgacgatgaacaggaagaagatctgcgtcgcgccgaaggtgaacgcgccgatggacgacaccatgttgaaatcggcgaactgcaggttgtagtccgggatccgccgcggcatccccgccaggccaacgaaatgcatcgggaagaacgccatgttcatgccgatgaaggacagccagaagtgcagcttgcccagggtttcgtcgtacatgtgcccggtccacttcggcagccagtaataagccgaggcgaagatgccgaagatcgcgcccggcaccagcacatagtggaagtgcgcgaccacgaaataggtgtcctggtactggaagtccgccggggcgatggccagcatcagcccggagaagccgccgatggtgaacaggatcacgaaggccacggcgaacagcatcggcgtctcgaaggtcagcgagccctgccacatggtgctgacccagttgaagaccttgaccccggtcggcaccgcgataagcatcgtggcgtacatgaagaacagctcgcccaccagcggaatgccgaccacgaacatgtggtgcgcccagacgatgaacgacaggaaggcgatactcgccgtggcgtagaccatcgaggtgtagccgaacagcggcttgcgcgagaaggccgggatgatcgcgctgacggcgccgaaggccggcaggatcatgatgtacacctcggggtgaccgaagaaccagaacacatgctggaacagcaccggatcgccgccgccggcggcgctgaagaagctggtgccgaagtggatgtccatcagcatcatggtcacgcagccggccagcaccggcatcaccgcgatcagcaggaacgcggtgatcagccaggtccagacgaacagcggcatcttcatcagggtcatgccgggagcacgcaggttgaggatggtggcgatcacgttgatcgcgcccataatcgagctgatgcccatcaggtggatggcgaagatgaagaaggtcacgctttccggcgcgtaggtggtggacagcggggcgtagaaggtccagccgaagttggggccgccaccgggcatgaacagggtcgagaccagcagcaggaacgccgccggcagcaaccagaaactgaagttgttcatccgtggcagggccatgtccggcgcgccgaccatcagcgggatcatccagttggccaggccgacgaaagccggcatcaccgcgccgaagaccatcaccaggccgtgcatggtggtcatctggttgaagaattccggctgcacgatctgcaggccgggctggaacagctcggcgcggatcaccatggcgaacgagccgccaagcaggaacatggagaaggcgaaccacaggtacagggtgccgatgtccttgtggttggtggtcagcacccagcgcatcaggcccttggcggggccgtgggtgtggtcgtgatcgccaacgatggcatgaccctgttcgtcgctcacagcgttcatggcctgtctcctgtaaacgggtgggctggacgatcgagggcggcacgccctgatcggctgcgggaacacgcaatggaccgggtcatttgctttgcgcctgtttcagagccaggacatccttgggcgtcaccatgtcgcccttgttgttgccccaggcgttacgttcgtaggtgaccaccgctgccaggtcgacttccgacaactgcttgccgaacgccgccatggcggtgccgggcttgccgtggaagacgatattcaagtgatccgccaccggcccggtggcgatcttcgagcccttgagcgccgggaacatcggcggcaggccctggccttcggcctggtgacaggccacgcaggtggtgtggtagaccttgtcgccacgggccaccagctcttcgagggtccattccttgctggtcagttccttgagcttgagggcttcggccttgcgttcgcccagccaagtgtcgtagtcggcctgggtcttcacgtcgaccacgatcggcataaagccatggtccttgccgcacagttcggcgcactggccgcgatacaggccgggcttgtcgacccgggtccaggcttcgttgacgaaaccggggatcgcatcgcgcttgaccgcaaaggccgggacccaccaggaatggatgacgtcggcggaggtcaccagaaagcgcaccttggcgccgatcggcagcaccagcggctgatcgacttccagcagataatgctcgcccttggcgctctggttatgaatctggtcggcgggagtggtcaggttgctgaagaactcgacgtcctggcccaggtatttgtagtgccacttccactgatagccggtgatctggatgtccacatccggttcgctggcgtcgtacatcttgatcagggtcgcggtggcgggaacggccatggccaccaggatcagcagcggcaccacggtccagaggatttccaccgtcgtgctttcgtggaacttggcggccacctggccggtggagcggcggtgcaggatcatcgaccagaacatggcgccaaagacaatgacgccgatcaccacacagatccagaagatggtcatgtgcaggtcgaataccgcgtgacttatatcagtcgctccaggcgccatattcacggtccaggcgccatgcgcctggctgaataccgaccacaacaggaggcccatccagacttgtggatgtcgcatcattgcgggttccccttatcgttcttgttatcccgccggcttgcacctgcggccaagggagcggctgcctagactacgaacttaaaccgccgagccttcgctgcgcatgcagtcgggcgtcatcagctaacttcattcagacccgagtatagacagcgacctcgacctcgcaacgcggtgccgtaaatccactgaaacagtttgccgctgccttataggccacggttggaaagggataggggatcaatgatggcgaagcgatataacccagacgactaaccatgaaataattatgaaaaatacgtcttaagcgatttcgtgagcaggctaacttatgtcttccctaattaattgcccttgtttcctggagtattcatgaacaccgccgcattgcgcgagcagatccaacgagcccatcaacatgagtccggcaccgggcaattgcgccgccagctggaaacccaattgccacacctgcaccccgccatccagctccccgaagtggacgcccagggggtgatgacccgttttgtcgccgcttatatcgatcaggttcccgacctgctggacgccgccaacgaagtcgcgcgcgaagccggtatcgagtcgcagatcaaaccggtgctgaagatcgccgagcagttcttcctccagccgcccgccatcatggccggccacgaaggcctggacagtctgctggacgaagcctatctggcccatcgcttggtggaggaggtcaacgacctgtacatcacgcatttcggccagccgctgattcccctggacaccacggtggccaacctgatcgcccaccagttgatcggcgaaaccttcgccaaccagctggacgaagcggtgcaccatgcggtcgacgcgatgctcgacgaagagagcttcgccctggagtcggtcgaggcctaccgggaaaagctcaacagccccgacaccgatgccgcctggaaacgctggccgtgcctgtcgcgccaactgggcgtggaactggaactcgaccagccggctgcctgatgattgcaggtggcggccctgtagccgctgccgcaggctgcgatcgaccggcacggtcgcagcgatatcaccgacgctgaaggcccttcggaccttatcgcagccttcggcagcggctacagggctacagacttacgcccggctcagacctttggcctccagcttcgaggccgggctcacgcccacggtggtgtgcaagcgcccctccaggcggcgcttcaacccgcgcgactcgatcaccagcttcgagcccttggccgcattggcccgcccccactcctcgagcagctccaggcaggcatggtcgatgtagcccaggttattgagcggcacatgcacggtggtgcccgctgggatgctgcccagcgcctgggtcagggccggcaccttgaggaaggtcgcggcacccaccaggcgcagctccatttcgccttcggtcggcaggtccaccaggctgatcttcagccgcgaagcgccccaggccagcttcaccagggtcaggccaaaaccgatcagtacaccggtcagcaggtcggtgaagacaatcgccagcgcggtcacgccgtaggtcagcatcggcatcggcccataacgacccagcttgcggaacgacttgaggtccaccagcttgaacccggtgtacaccagcacgcccgccaggctggccaccggaatgctttgcagcacgctggacagcaacagcacgaacgccagcagccacaaaccgtggaagatcgccgacagccgcgtggtcgcgcccgcctggacgttggccgagctgcgcacgatcaccccggtcatcggcagggcgccgagcaacccgcagagcatgttgccgatcccttgcgccgatagttcacggtcgaaatccgagcgcgtaccgctgtgcatgcgatccaccgcggcagcggacagcagtgtttcggcgctggcgataaaggccacggcaaaggctgcgatcagcagtgtcgggtccgccaggttgagcagatcggccggccgcagccagtcgatcgcctcggcaaggttttccggcacttcgacccgcttgacctgcagcgccaggagcaggctggcaaaggtcgccaagccgacacccagcagggcgccggggatgaagcgcagcgaatgcgggcgcagtttttcccacaggaacatcaccgccatggtcgacaggccgagcaacccggcctgccagccaaaaccgccgcccaggctgggcaacgcctgggccaccgcctcggggaagcccgcgaggttatccaggccggacgcctggggttgggcgtcgagcatcacgtgcacctgggagagcacgatcaacaccccgatcccggcaagcatgccgtagaccaccgccggcgccgtgacccgaaaccagcaacccaggcgcaggcgcccggccaccagttgcaggaaacccgccagcagcaggatcggcccgagcatggcgataccgtgctggcgcaccagctcgaacaccaggaccgccagccccgcggccggaccgctgacctgcaagggcgagccggccagccagcccaccaccaggccaccgatgatcccggtgatcaaccccttggccggcggcatgccggaagcgatggcgatacccatgcacaagggcagggccaccagaaacaccaccacggaagcaagcagctcccgtggcaaaacagctttcaattgtgctgcacgcatgatgattctcccgaagctttcttcaggcgtggcaaagcctgaccgcgcagacggcagtcatggctgaaccccactgggatttaggaggatttagaagcgcgctttaggcgtcgcaaccgggatcggatggcgtccgtccaacggcaggaaacacccttgatccgcgtcgtaggctttgatttcgctggtttcgatgttgtacacccagccatggatgaacaactgaccgttggccatgcgcgaagccaccgaagggtgggtgcgcaagtgctgcaactgggcgatgacgttctcttcggtcagcacatgcatgctggcgttctcgtcggcgcagtcgcagttctcctggaccatggtcttggccacttcggcgtggcgcagccaggctttgaccgtcggcatcttttccaggctctgcgggttgagcaccgcgcgcatggcgccgcagtcggaatggccgcaaacgatgatgtggtgcacacccagggccataaccgcgtattcgatggccgtggacacaccgccgttcatctgcccgtaaggtggtaccacgttaccgacgttgcgggtcacgaacaggtcgcccggggcgctctgggtaatcagttcggggacgatgcgcgaatccgcgcaggcaatgaacatcgcccgcggccgctgggccgtggcgagtttcttgaacagttcttcctgctgtgggaagacctcgtgatgaaaatgcaaaaagccgtcaacgattatctgcagcgctgcatcggcgctttcggcgacctccggggacgctgaagccgacgcagccaacggctgtttatccttgtcactcatgattcatcctctttgacggattaggtgaattttccagttttatccggcacgacgccagcgattgattaaaaaacaaccagaccgctgacagcgacccatcggtcacttggtgaacaaggtagccttccaaacttaactcaaactgaaccggccgctctaaaacgccactattggcgatgcaaaaaggtgaccagcgtatagacggtggtgcatcggcactactccaccataggccaatacatcctagagcaacgacatctgccctcccggcggacagaacgccgtgcagtcgaggttgtagccttcgcgccgatcgagccccaggcgtttgctggccttggcgaaacgctgcgccagcagggccgcgaaggggccttcgccgcgcatccgtgcaccaaaacggctgtcgtacagctcgccgccgcgacactggcggatcaggctcaggacatgggccgcccgctgcggatagtgggcgttgagccattcctcgaacagcggcgccacttccaggggcaggcgcagcatcatgtaggcggcgctttgcgcgcccgcggcatgggcctcggcgagcaggctttccagctcgctgtcgttgatcatcggaatcatcggcgaacacagcacgcccacgggaatccccgcctcgcgcatcacccggatcgcccgcaaccgcgccttgggcgccgccgcccggggttcgaggatgcgcttgagctcgtcgtccagggtggtcaggctgatcatcaccgccaccagccgctgctcggccagttcggccaagaggtcgaggtcgcgcaggatcagcgagcccttggtgacgatggtcaccggatgccggtagcgcagcagcacctccagggttcgccgggtcagctggtgttcgcgctcgatgggctggtaggggtcggtgttggaccccaggttgatcggcgcgcactgatagccgggcttggacagctgctgttcgagcatcgccgcggcattggtcttggcgatcagcttggtctcgaagtccagccccggcgacaggtcccaataggcgtggctgggccgcgcataacagtagatgcagccgtgctcacaaccacgataggggttgatggagcggtcgaagggcaggtccggcgagctgttgcgggtgatgatggatttcgccgtctcaaggcgcacctcggtgccctgggtcagcggggcttcctggtaccagccgtcgtcgaaggccaccgagcgctggggcgcaaaacggttgtgcgggttggtcgcggtgccacggccgcgtgggggcagggggctggacatgggcaggcactctattactgtatttatatacagtaatagaggtttgagctgttgcaaagcgccgtcgggcggagcacgccgttggcgctgatcgcgagcaagctcgctcctacagcttttctggcgcgccattcattgatgatcgacgcgccccctgtagcgagcttgctcgcgatagcggtcgatcaaccgccgctgtgcttcgtcacctgccccaggtcgtcgttcgaggtgctttgcaggtcgcccttgcgcagtcccgccacatccgcggccttcacctcggaaccctggttgccccagctggtgcggatgaagttgaccacatcggccacctcctggtccgacaggcgccaggcgaaggccggcatggtgaaggtcgatggcgcggtatgggtcgccggcaaggtaccgcccttgagcacgatgtggatcagggacgtggcatcggcgctttgcagcaccgggttgcccgccagcgccgggaacacccgggtatagccatggccgtcggtacggtggcacgccgcgcagttgtcgatgtacaccgccgcccccggcttgctgtcgtcacctttccacaacgcctcggccaccgccttgtcgtactggtgcggctggtcgttggcgtccaccgccggtagcgacttgaggtaacgggcgatggccgtcaggtcgtccgcggacatgtactgcatgctgtgcaccaccacgtcgctcatgccgccgaacaccgcgccgcggtcgctgcgaccggtcttgaggaactgcaccaactgctcttcgctccagctgccgaggccgtccttgtggtcaccccgcaggctcttggcgatccagccttccagcggcgcactgccggccaggaagtcgctgccttcgctggcgctcagggctttctcctgcatggtcaaggcgcgcggcgtatgacaggcgccacagtggccgaggccttccaccaggtaagcaccgcggctgaccaccgggtcttgcgcagcctgcgcctggccgctgccttgcgcgcccgccacgctcggcgcgaacatccagcgccagcccgccagcggccagcgcatgctcagcggccaggggatgtcgctgtcgcggttctcctggaccaccggcgccacgccttgcatgaagtaggcatacagcgcctgcatgtcggcgtcgctgacccgcgcataggacgggtagggcatggccgggtacaggctgctgccgttcttggccacgccatggcgcacggccttgtcgaagtcgtcgaagctgtactcgccgatgccggtcttgtccggggtgatgttggtggaatagatcgtgccgatcggggtttccatcggcaggccgccggcgaacggcttgccgtccttggcggtgtggcaagccacgcagtcaccggcacgggccaggtattcgccctgcttgatcaaggcttgccgatcggtttcggcggcgcagagggaagcgctgccgagcagcgccagggtcgcgataacgagggttttcatggtcatcgctccttatgcctggaccagcgggccggggttcttcaggtactgctcgcggatcgcgcgggccgaccagtaggtcaacgcggccaccaggccggtcgggttgtagcccaggccctgggggaaggccgaagcgcccgggacgaacacgttgtgcacgtcccagctctgcaggtaacggttcaaggcactggttttcgggtcggtgcccatgatcgcgccaccgttgaggtgggtggtctggtaggacgcggtgttgaagtgctcgccgaccttcttgcccagcaccgcgatggccttggggttcatcgcctcggcgatcttgcccatcttctcgaccatgaagcggttcatcttgatgtcgttttcctgccagtcgaaggtcatgcgcagcagcggcaggccgtaggcgtcgcggtacaccgggtcgagatcgaggtagttgccacgataggactggtgggcaccgtgggcgtccatcgacacctggtgggtgtagtagtcggcggtggccttcttccaggcgctgccccaggccggagtgcccggcgggttggaggtgccggcgatcggccggctgccggcctggttgacccagaacggcgaaccgccgacgaagccgtgggggccgtggtcgaagttgtcggcgttgaagtcgtccaccgccacgccattgccgccggcgccgatgaagttgttggtgtgcacgtccttgtcgaagtaggccttgatggtggacatgttctggtaggcgaagttcttgcccaccacgccttcgccagtgatcgggtcgtacggcttgccgatgccggacagcagcatcaggcgcacgttatggaactggaaggcaccgaggatcaccaggtccgccggctgctcgatctcccggccctggccgtcgacgtaagtgacgccggtcgcacgggtcttggtgctgtcgaggttgaccttgagcacgtgggagttggggcgcagctcgaaattcggcagcggcttgagggccggcagaatgttcacgttcggcgaagccttggagtacatgtagcagacgtagccgctgcagaacccgcagaagttgcacggccccatttgcgcgccataggggttggtgtacggccccgaggtgttggccgacggcaggttgtagggcttgtagccgacttcgccggcggctttctggaacagctgggcggagtaggtgttcttctgcgactccagcgggaaatgctccgaacggtccggcgcgtaagggttgccgcccttgccttcgccgaccagctggcctttcacggtccaggcctggcccgaggtgccgaagactttttccgcgtagtcgaagaacggctccagttcttcgtaggtgacgccgaagtcctggatggtcatgtccttggggatgaagtgcttgccgtagcgttcttcatagtggctgcgcatgcgcagctcgatcgggtcggcgcgaaaatgcacgccggaccagtgcaggccggcgccgccgacgccgttgcccggcaggaacgcgcccagctggcggttcggcagggccacgtcgttgacgctgtggcgaatggtcaccgtctcccgggagatgtcctggaagagcttcttgcgcacgctgtaggtgagctcgtcgatcacctgcgggtagttgccgtccgggtaggtgtcctgcatcggcccgcgctccagcgccagcacgttgagcccggcctcggtcagctccttggccatgatcgcgccggtccagccaaacccgacgatcaccgcgtcgaccttcttcattaccgttgccatgctcaagccctctcgccgcgaatcgacactgccgggaaagggtattgctcgttgcgttccacccagtccatgaaatcggcgcgagcgccggggaagccgatcaaggtccagccgaccatgcctttattgccgccgtggatcgggtcgcagaagaacccttccttggtgttttgcagcaaaaggttgaagaaaatcttcggtggaacgctgtcgaatggaggttttcccgcttcgagctgcttgagcaaatcgtctcgggtagcgctgtcttgcgcggcaaatgttttaccgttgaaggctttcgaccatgcatccgtcgcggcaatacccaggcgatagatctccttgggcaccagtttgctctgccagcccatctccggcgcggcgtcggcgttgaacggaccttgcatgtaccacagggcacccgcggcgtagggggtgttcatctgtcggtcgatgtattccggcacaccggcttccagggcgcccgggccttgttcgtcggtcgggatcaggcgctctaccgcggcctggacaaaggcccactcttcggcggtgaaataggtcggctggtaagcctcggtgctgaccggggttcgggccggttccaccggcttgggcgcttcgggggcggccatcagcatcgagctgccaagaccggtactggcgaccgtgaccaccgggatcaaggtcagggatttgcgcagaaactcacgccgcgggttgtcttgatcgtgatcagacatgggggtgcacctcacactaggcattcacgggttgggcagccgcgtcatggcgtggcttgtcgttctggcggcgattgggagcgccggggaaacacagttcagcaaactttggttacaaatggtagcaggctaagcattcgaataaatcgtttgcgttgcaaaaaagtcgcgattgccgagaaaaaacctctatcgcagtggcttcacgtttctttgacgagcgcctcacaggccgttgaccggcccggatggaagctaggctccctccatccccatttccggtcacggccttgcgcatgcacaactttcctacccttcccgccttctgcctgttcctgctgacgctgcttgcctggccccaggcccaggccgccgaaaccggcgcgacccgcccggcccagtgggcccagccggtggaaacccactacaacctgtaccagatgtcgccgacgctctaccgcagcgccttgccggacggcggcgccgtgcctttgctggaaaagctcaaggtgggcacggtgatcaacttcctgccggagtccgacgccagctggctgcagaccccggcaatcaagcaggtgcaattgccttaccggaccaatcacgtcgacgacgccgatgtgctggcggccttgcgcgcgatccagaacgccgaaagcgagggtccggtgctgatgcactgcaagcacggctcggatcgcaccggcctgatgtcggcgatgtatcgggtggtggtccagggttggagcaaggaggaggcgctgaatgaaatgaccggaggcgggtttggcgacagttcccacttcaaggacggcattcgctacatgatgcaggccgatgtcgacaaattgcgcattgccctggccaatggcgattgcagcaccagcgtgttcgccacctgttcggtgaaaagctggttcgagacagtgagcttcagcaagccggcgaattgagcaagggaaggggcgatgcggtcactgtaggagcgagcttgctcgcgatagcagtgtgtctgatacgccgctatcgcgagcaagctcgctcctacacctacagagctacttgggttcgtcggtctttttcttcaacttggggttggggaaaaactgcaccgactggaccttggcgtccggcgccttgagggccgtggtgttgacccgcgtgcccagttccttgggcaccgacagcccctgttcattcagggtgtcggaataaccgcaggccacgcactcgcgatggggaacgtcgtcttcgctccacatcatcaacttgtcctgctcgctgcacgccgggcagaccgccccggcgataaagcgttttttcgtcttcactggcccctcgctcatgccgctgcgtcctcggtgaggccgctgtggcgcaagagtgcgtcaatcgacggtgcgcgtccgcggaagtcgacgaacagcaccatcggctcctgggaaccgccacgggccaggatcgcctcgcggaacgcgcgaccggtctcggcattcagcacgccttcttcctcgaacttcgagaaggcatcggccgacagcacttcggcccacttgtagctgtagtaacccgccgcgtaaccgccggcgaagatgtgcgcgaagctgttggggaagcggttgtaggccggcggacgcatcaccgagacctcatcgcgcacgccttcgagcacctgcagcacgctacggccgtcgccatgggtggcatgcagttcgaagtcgaacagcgagaattccagctggcgcaccatcatcaggccggactggaagttcttcgccgcgagcattttttccagcaggtcctcgggcagcggctcgccggtttcatagtgaccggagatcagcgccaggccttccggctcccagcaccagttctccatgaactggctcggcagctccaccgcgtcccaggccacgccgttgatgccggaaacaccggcatgttcgacgcgggtcagcaggtggtgcaggccatggccgaattcgtggaacagggtggtgacttcatcgtgggtcagcagggcaggcttgccgctgtcggccggggtgaagttgcacaccaggttggccaccgggctttgcagtacaccgtcaatggtgcggcgacggtcgcgggcgccgtccatccaggcaccgccacgcttgttggcgcgggcatacaggtcgaagaagaaacgccccacgtgctggccgttttccttgatctcgaacaggcgtacatccgggtgccagctgtcgaagcctttcagttcggcgatctcgatgccgtacaggcgctggacgatggcgaacaggccgccgagtaccttgtcgatcgggaagtaggcgcgcagggtttcctgggccacgctgtagcgctgctcgcgcagcttctcgccgtagaaaccgctgtcccagctttgcaggtccgggcagccttgctcggcggcgtaggccttgagctgttgcaggtcctgggcagcgaacggcttgctgcgcttggccaggtcccgcaagaagctcagcacctggtcgctggactcggccatcttggtggccaggctcagctcggcgaagttggcgtagcccagcagttgggccagttcctggcgcaggtcgaggatttcctgcatgaccgggccgttgtcgttctggccggcgttcgggccctggtccgacgcgcgggtgcagtaggcggcgtagacttcttcgcgcagcgcgcggtcttcggcgtaggtcatcaccgcgtagtagctggggaattccagggtgatcagccagccttgcaggtccttggcctgggccgcggcagccatctgcgccttggccgacgcagtcaggccggccagggccgcttcgtcggtgacatgcttggtccaggcctgggtggcatcgagcaactggttggagaagcggctgcccagctcggagagcttgctctgcacttcggcgtaacgcttctgctgctctggcggcaggtcgatacccgacaggcggaagtcacgcagggagtgttccaggatggttttctgcgccacgtcgaaaccggcggcttgcgggctgcccgccagggcttcgaaggcctggaacagctcgcggttctgccccagctcggtggcgtaggcgctcagggccggcaggcaggactcataggcctcgcgcaattcggcgctgttgcacacggcattgaggtggctgaccggactccaggccgcgcccaggcggtcgttgagttcgtccatggccagcaccaggccggcccaggtcggttgcgtgccctggttcttgaggatttcagcgatggcggcgcggttgtcagccaggatctgttcgatggccggctgtacgtgctcggcgcggatcgccgaaaacggcggcaggtcgtagggctgcagaagagggttgttcacactcacggttggcaccttggctggaagaaacatgctggaagaaacgtagcgtcatcttaattacaatcgacgcccaccgcagctatcgaccccattaataaatgtcagagcaggtatccaacttggccattcgcagctatcagaatcacacgcccatccttggcccgcgggccttcgtcgacagctcggcggtggtgatcggcgacgtcgaaatcggcgccgacagctcggtctggccactcacggtgatccgcggcgacatgcaccgcatccgcatcggcgcccgcaccagcgtgcaggacggcagcgtgctgcacatcacccacgccggccccttcaacccggacggcttcccgctgctgatcggcgacgacgtgaccatcgcccacaaggtgatgctgcacggttgcagcgtcggcagccgggtgctgatcggcatgggcagcatcgtcatggacggcgcggtggtggaagacgatgtgatcgtcggcgccggcagcctggtaccgccgggcaaacgcctggaaagcggcttcctctacgtgggcagcccggtgaaacaggcccgcccgctgaccgacaaggagcgtgccttcttcacctacagcgccgccaactacgtgaagctcaaggacctgcacctggccgaaggctacgaccaggcttgagccccgacccactgcccaggaattcccatgcattaccaaaccgttctgttcgacctcgatggcaccctgaccgacccgcgcgaaggcatcacccgctcgatccagttcgccctcggcaagctgggcatcgacgaacccgacctgagcaagctggaacacttcatcggtccgccgctgctgcaggcgttcatgcagttctacggcttcgacgaagccagggcctgggtggcggtgaatttctaccgcgagcgtttcaaggtcaccggcctgtatgagaaccgcgtgttcgatggcgtcacgcccctgctggaaaccctcggcgggcaaggccgccagctgtacatcgcgacctccaagccatgggtgttcgcccgcgagatcgcccggcacttcgatttcgcccggcacttcaaggtgatctacggcagcgaactggacggcacccgcaccgacaaggtcgagctgatccgccacctggtcagcgaagagggcctggacccgagcgataccctgatgatcggcgaccgcaagcacgacctgatcggcgcccgccgtaacgggctggatgcggcggcggtgggttatggcttcggcagccacgaagaactgagcgccgaggcgccggcctaccacttccagaccctggatgagctgcatcaggcgttcctgcagcgctgaaccaccggccatcgcgggcttctgctcgacgctcgcttgcccgcgatggcgtccctttcaagcggcgttcatcagtgcttgcagcgccgccttgcgcttttcagctggcagcgcgccgagcttctccacggcctggtaaaaggccggccaatccccgttcgcctgcttgaacaaggcggcgaatgccggtacccactggtcgtacaggccaaaaggcagcagcctggcattgttcagcggggtgttgatccagaagtcgtagcgcgagtcgccatgccattggctgtccttcagctgtcggtaatcccggcgcagctgttcgaattcggcggccttgcgctggcgcatctgctcggctgggagcggcagggcatacaggcgttccaggcgctggcgggtatcgaggatcaactggatgaactggtccttctgcttgaccagggcatcactggccggcgccaggccgcgagccgcgcgccattgccgggtgccttcctgctcgacgaaggtggcgaaggactcgttgaactcggtgtcgtccttcacataaaagcgctgatgggccagctcgtggaagatcagggtcgccaggcgctcgtcgccccaatgcagcatcgaactgaggatcgggtcgttgaaccagcccagggtcgaataggcctccaccccgccgatggccacatccatgccctgctgtttctgcaaggccgcctcgccgcgggccgcgccctggctgtagtagccgcgataggccacgcagccggcaatcgggaaacagtgggtcttggggctcagggaaaactcaggggtgctgaatacattccacaccacgtagggccggccgatgtcggcgtagaggcgatagctctggttgtccggcaggtgcaggtgctggctggcaaaaagccgggctttctgcgactgggccagatgggcgcgcaataacgggtcgcgagccgggtcggcgatgacctgctcgaccggcgtacgggcctgcaacagctgccattggccactggccagctggccgtagtaacccacgctggaacaaccgttgagcaacaaaagcagcaagcccggaaacaaaaagcgcaaaagatgatcaagtaacccatggcttgaacgcggcctaatcaaatcgaatcatccttcgagagtctgcccccaagactatctcgcctgcctggagtttcgctatgcgcgtgttgctgctgaccaccggactcttgaccttgagcggctgtgccggattgcccgcccccgatccgacgcaagcctggatcgacctcgacacccaccaggacaccgccctgcaggcgctggaggtcgacgaaaaggcctgggtggaccgccgatatttcgaggtccagcccggcaaccatgagctgaaggtgcgctaccagttcgccgtggagcccaccaatatcggcccggacagcgaaccgctgtggcgcgactgccagctgaatgtgaaatacaaggacttcaacgccggccaacgctatcagttgcagaccggcaatatcggcttccggccctgggccaaactctatgaccagcagcgcaatctggtgggtaccggccaaccggcgggctgccagcgcacctgatcggcgctatgcttgaggcctttccccggacggcccgacctcatgcgccaacccttgctgctgcttgccctgaccggcctcgttgcctgctccagccccctgccggcggtggatccgcagcaggcctgggtcgatttcgccaccccgacgccgggcggcaagctgctgatggccgagcgcctggacaaccagcgcctgaccgacggccgctatttccaggtcaccccgggcagtcatgagttgatggtgcgtttcgatttcgaggtgttcagcgggcgcctcggcctgctgaacgatccggccgagcgcctgtgctacctgagcgtgcgctacgaccatttcgaagccggccagcgttacctgctggaagcccgctcgctgggtttctctcccagtgcccgactgtacaacgccaagcgtgagctgctggccgaagaccatagggtcaactgcgtgatctgaacgatcagctgtcgttgcgctgatagatgattgccttggtgccgttttcacaggtaccgaccaccatggccacgtcgtgcttttcggcctcctccttgctgacaatctccagggtgtaggagggcacggcgttggcctggatcttgatttcaatctctttcttgagttcttcgcaatccttcggagccgccagggccgaggtggccagcgcgcaacaaacaactgccagggcaaaacgtttcatgatgtggagctccctttgatgcagcgcccatggtcatgggctgagcctgcagtcggctattcgaccacattttcatgaagcgagttctgacgtcgcgcatatcgggcgcgggagtttcggcaggagtgcaatcgcgagccagttcgcgcctacgggttcgaaggcatgagcgagctggctcgcgaaacgacagggcaggttaaaacaccgtcagctgaccagcgtcgcatccaggctgatcctggcattcagcaccttggacaccgggcaaccttccttggccttcttgctcagctcatcgaactgctgctggctggcgccgggaatcttcgccttgaggatcaggtgcaccgcggtgatcgcaaaaccgccatcgacctggtccagcgtcacttcggcgttggtgtcgatgctgtcggccttgagcccggcctcgccgagaatcatcgagaaggccatggaaaaacaccccgcgtgcgcggcgccgatcagttcttccgggttggtgcccttgccgccctcgaaacgcgccttgaagccgtaaggtgcatcgcgcagtaccccggtttccgtggaaatcgagccaatgccggttttcaggtcgccttcccagtgagccgaagctttcttgatgatgctcatgtctgtctcctcgagaacgggcgcgaaagaccgcgccctggtggttttctgctactcagggttctagaggatagaaggcccggcgaagttcatcctgtctgaatccgccgtttatccggacagcaaattcagcctggctattgaaactcgggtatatgcccacattgcatgaaacaggcttacagcattcggcaggttttggctcatgacaaaggcctgcacaccaaaggagaagcaggttcatgaaaccactgtccgacgttaagttttccaccctcgacctggtccccgtgcgcgaggacggcagcccggcgcaatcgctgcgcaattccctggacctggcccgccatgtagagaagttcggctacacccgcttctgggtcgccgaacaccacaacatggacggtatcgccagctccgcgacctcggtgctgctgggctacctagccggcggcacctcgagcattcgcgtcggctccggcggcgtgatgctgcccaaccatgcgccgctggtgatcgccgagcagtttggcaccctggaaagcctgtacccggggcgcatcgacctgggcctgggccgcgcaccgggttcggaccagatgaccgcccgcgccctgcgccgcgaacggtccggcagcgccgacgacttccctgaagacgtggccgagttgatggcctacctcggcccacgcaccccggaacaacgagtgatcgcggtgccgggaaccggtacccaagtgccggtgtggttgctgggttccagcctgttcagcgcgcaactggccggcgagcgcggcttgccttacgccttcgcctcgcatttcgcgccgcgctacatgcacgaggcgattcgcgtgtaccgcaatcacttcaagccttcagccgtgctcgacaagccttatgtgatgctcggcgtgccgctggtggccgccgataccgacgaacaggccgactatctggcgacctcggtgtaccagcggatcctcgcgctgatgcgcggccagagcctggtgcagcgcaaaccggtgaagagcatggacggcctgtggctgccccatgaaaaagaggcggtgggcagcttcctcggcctggccatgatcggcagcccggcgaagatccgcgccaagctcgaagtgttgatcgaacagaccggcgccgatgagctgatcttcacctgcgacctgtacgagcacgccgaccgcctgcattcctacgaactgctggcgcaagtgatgaagggttgagtctgcgatcgggccgaaggactgggtgatccagaggccctgcgcgcccttcggtcgtgatcgcagcctgcggcagcggctacaggggcatgcctggcctgagtaataaccgggcacaaaaaagccgacgcattgcgtcggctttgttcattgctacaagggctcagccgcgcttgtagacgatttccttggtaccgccttcgcaggtaccgaccactttgccatcagtcgcgctgcctttttcgacaatttccagcgaataacccgacacccctttggcatcgatcttcgcggcgatttcgcttttcagctcttcgcatgatttgccggcagcaaggactgttcccgcgacactcaacaacgctaaagccattaccagttttttcatcggtcacattccctggtcgaatcaaaataagcgtcaagccccggcctgctcggcatcgaggcagatatagcgctttgccattccctatggcaatcggccagcgcacaagttcaacagcctagcccaggttcagctgttggcaatgcggaaaccgactttgagcgtgacctggaaatgcgcggccttgccatccttgatatgcccacgggtttccgtgacctcgaaccactccaggtgctggatgcttttgctggcttcggccagcgcattgttgatggcgtcttcgatgctgctaggggacgaaccgaccagttcgactttcttgtaggtgtgatgatcagacatggcgcgctctccttatgaggtagatcaaagcctagcagcgattagcggcaacacttgagtgagccccggcccatcgaagttcagatttaatgcactttcgccaggccgcgcagtcggaccctacagaccctcaatcaacaatgcaggagagccaccatggccaacacttcgttacgcaaagcctcattggaaagcatggaagccgagatcgaaagtctgctcaagtccctggagagcctcaaggacgacgcttcggacgaatcgcgcaaaaccctcaaagcgctgaaaagcaacgccgagagcgcgctgagacattcgcgcagcctgctcagcgatgcctatgaagaagtcaaagtgaaaacccgtgaaaccgggatcgccacccgcgactacgcccagcagcacccctggaccaccgccggcgtcgccgtgggcgcgctgggcctgctggccgcttacctgctgtgcaagcgcggcaattaaggcgtctggcgcaactcgttactgagccactgcgccagctgccgggcgcgcccgtccgcggcgcgcttgggtagccacaacgccagttgccccggggtttcacagaagccccacggggcaaccaggcgtccggcacgcaggtcctcggccaccagcggctgcggcgcgatcgccacacccagcccggccaccgcggcctccagcaaataatacaaatgctcgaaaccctggccgaacttcagcgctccggcgtcgatgccgttctgccgtgcccagctgggccaggcctgcgggcgcgaggtggtctgtagcaacgtctcgttgagcagcgcactggccggcgcctcgcgcagttgctcgtaacggctgtagcgggggctgagcaccgggccgatgcgctcgctggccagctcaaagacctgcatgtccgccggccacggcggctcggcgaataccagcaaggcatccagccctggccggcgcgggtcgagatcgccttcaccggccgacaggtgcaggcgcaggtccggcaggtcggcattcagccgccccaggcgcggaatgaaccagcgcgccagcaggctgccggaacagccgagcacgaagggcgcatcgacggtgctctgggtcagctcggcgcagaccgtgcgcaggcgctcgaaggcatcgctgctggcatcgcgcaggcgcacaccggcatctgtgagtttaaggccgcgcccttccttgacgaacaggctcaccccaagatgctcttcgagcaccttcaattggcggctgaccgcaccatgggtgacatgcagctgttcggccgcctgactgacactgttcaggcgagcggtggcttcgaaggcccggagggcgttcagcgggggcaggtcgtggctcatgggatatgtgagttttcctgacaggttgtggcgatcttatcggttttcagcctgggacgtcaggggtagagtgaacgccattgtctttccagcattcacccttttgacgaatcaccgggagcgccccatgaaccagaccaacctgcgcaacggtcctgatgccaacggcctgttcggcgcgttcggcggccgttacgtcgccgaaaccctgatgccgctgatcctcgacctggcccgcgaatacgaagcggccaaggaagatccggagttcctcaaggaactggcctacttccagcgcgactacgtcggccgtccaagccctctgtacttcgccgagcgcctgaccgagcactgcggcggcgccaagatctacctcaagcgcgaagagctgaaccacaccggcgcgcacaagatcaacaactgcatcggccagatcctcctggcgcggcgcatgggcaagaaacgcatcatcgccgagaccggcgccggcatgcacggcgtggccaccgccaccgtggcggcccgtttcggcctggactgcgtgatctacatgggcaccaccgacatcgagcgccagcaggccaacgtgttccgcatgaagctgctgggcgccgaagtgatcccggtggtcgccggcaccggcaccctgaaggatgcgatgaacgaagccctgcgtgactgggtgaccaacgtcgacagcaccttttacctgatcggcaccgtggccggtccgcacccgtatcccgccatggtccgcgacttccaggcggtgatcggcaaggaaacccgcgaacagctgcaagcccaggaaggccgcctgccggacagcctggtggcgtgcatcggcggcggttccaacgccatgggcctgttccatccgttcctcgacgacaagagcgtgcagatcatcggcgtcgaagccgccggctacggcatcgagaccggcaagcacgcggccagcctgaacggcggcctgcctggcgtgctgcatggcaaccgcaccttcctgctgcaggacgaggatggtcagatcatcgacgcccactcgatttccgccggcctcgactacccgggcatcggccctgaacacgcctggttgcacgatatcggccgtgtcgaatacacctcggtgaccgacgacgaagccctggccgcgttccaccagtgctgccgcctggaaggcatcatcccggccctggaaagcgcccacgccctggccgaagtgttcaagcgcgcgccgaacctgcccaaggatcacctgatggtggtcaacctctcgggccgcggcgacaaagacatgcaaaccgtgatgcaccacatgcaacagtcccagcaggagaaacactgatgagccgcctgcaaacgcgctttgccgagcttaagcaacagaaccgcgccgccctggtgaccttcgtcaccgccggcgacccgggctacgacgcttccctggcgatcctcaagggcttgccggccgccggcgccgacgtgatcgaactgggcatgcccttcaccgatccgatggccgacggcccagcgatccagctggccaacatccgtgccctggaggccaagcaaaacctggcgaaaaccctgcaaatggttcgcgagttccgtgtcggcaacaacgacacgccgctggtgctgatggggtacttcaacccgatccaccactacggcgtaccgcgcttcatcgccgaagccaaggaagccggggtcgacggcctgatcgtggtcgacatgccgcccgagcacaacgccgagctgtgcgacccgtcccaggccgccggcatcgacttcatccgcctgaccacgccgaccaccgacgacgcgcgcctgccgaaggtgctgaacggcagctcgggcttcgtctactacgtctccgtggccggtgtgaccggtgccggttccgccaccctggagcacgtggaagaggcggtgacccgcctgcgtcgccacaccgacctgccgatcagcatcggtttcggcatccgtacgccggagcaggccgcggccatcgcccgcctcgccgacggcgtggtggtggggtcggcgctgatcgaccagatcgccaatgccagcagttccgagcaagcggtggacggcgtgctgagcctctgcgcctccctcgccgaaggggtgcgtcaagcccgtgtcagccaagggtaaagttcctgatacagaggaattcgcctcagagtccacagactaaccagcaagaccaaggggttcagaaccaggttctgagcccctttttgttgttcgtgctctgaggaagacccgatgaaaatgcccaaacgcctgattgccggtctcggtgtgctgatgctcagcgccagcccgctgctgcatgcggtcgcggacccacgtgacgaccacgaccgcggcggcccgcaaccgggtcgctacgacaatcgaggagacaatcgcggggataatcggggcgatgagcatcgcggcccacaggccgaccgccgtggtggcccaccccgggatttcggcccggtgcgcgagaccattcgcgacaaccacgcctacttcgtacgcggcgcgccaccgccccacggcatccatctggtgcgcggccaaccgctgccccgcggctactacggcgaacgcctggacaaccgcgccctggcgcacctgccgtactacccgggttatgaatggcggcgcatgggcgccgatatcgtgctgatcgcggtgggcacggggatcgtctacgagatcctcgatggcgtgttgtattgatcggggctgatggcgcttgaaaggattccatcgcgagcaagctcgctcctacagaaagcgcctgaccttgtaggagcgagcgggctcgcgaaaaacctcaaaaaatcgacaggtccagcggcctgatcgcccccatccagatcgcatgctccgtgtgatccttcaggtcgtccccggtatcggggtgcaggaataccaccagcccgttgcgattgagcgccagccacggcaacacctcgcccaggtactgcggctcgaacgccagctggcagctccagtccgggtgcgggccgaccggccgttcatgcacccggcccatcttcaatggaaacaattgcgccgcctgctcgcacagggcccgcgcctggtcgatggtgctggcgtcgaaatagacgtgggcgtgatagcccttgatgcgttgcatggaacctctcatgacaaagtcgaaccctggcgacagcccacaggtcataaccttagcagtgtaaagaaacgggccgcgccatgaaaaatgccgaaaccccggtggtcaagctggtgctctacggtgccatgagcagcctgggcagcgcgctgatggcggaattcctgcggcgccagcatgaagtcatcgccatcctcgacgacctgacggccctcgagccccttcccggcttgcgcaccaaatgcggtgacctgttcgatgctgcgcgggtcaggcaaagcgtggccggaggcgacgtggtggtctgcctgctggatgccccggggctgcccatgggcctcgaacaacaggaaaacctgttgctcgaaccccgggagcaacttcgcgcggtcgaagcgctgatcgccggcatgcaggccgcgggcgtccggcgcctgttcctggtggggcatttcgaggtgctggaccagccggagatggaaggctacccacaccgccagacggccgaagccatcctcgacgcgctgcaaggcagcagcttgcgctggaccctggtgaatgcgccgcaaagcgtacccgggctgaccctggaacacttcagccaccccatcgacagccttgcacccgagcgggtcgagccggtgcagcgactggcgcgggtggctgccggcatcgccgacgaacagcagttgaacctgcatgtgggcgaacatgtgaacttcgtgtgctgaatccttatcgcgagcaagctcgctcctacagaaggttatgcgatcccatgtaggagcgagcttgctcgcgatggcctccacgccaaccccaaacctcagatggcaatcgacggcaggcccagcccggtcaaagattgcgcgctgtcggcctgctcggccatcagccagtcgaaaaaccgctggatcagcgccccccggcgtttgcgctggggcaggaccacgtaatagccgtagcgggaaatcagcgtttcgctgatcggccggcacaacagaccttgcgccagcaagttatccacaaggtggcgccagccaatacccacgccctggccgccgatcgccgcctggatcagcagggtgtagttgtcgaaacgcagctgccccggcgccggcggggtggcgatccccaactcgcggaacacgccgctccagtcgaaccagtggctgctgttttcccccttcaaatgcagcagcggaaactccagcagcgactgggcgcccaggggcagcggccgctccttgagcagcaacgggctgcacaccggaaacacttcctcgttgaacagccagtggctttcaccctgtttgaaacggccatcgccaaacagcaccgccacgtcgatatcggtgcgcagcatgttgtggctgcgctcactggtgaccaggcttacgtccacctgtggattggcggcgtggaagcgatgcaggcgcggcatcagccagtaggcggcgaaggcgaagtcggtggccacctgcagcacctcatgctgatgctgggcagtgatggcgctcaggccgctgtcgatgctctgcaagccggcctgcacctgttcgaacaactggctgccggcctcggtcagttcgatgccacggtaaatgcggtcgaacagccgggtgccgagctgctcctccagccgcttgatctgctggctgatggccggctgggtggtgcccagctctaccgccgcggcggtaaagctgcgctggctcgccgccgcctcgaatacgcgaaacaggtccagggacaggtcgccaagcgcttcatacataagctgtgcttatcctagtcattgccgtacatgggctttaccgtaaatgccttgggttacatgctcgatcgcagcactttcgcataactgcccactatggaatgccgcgaatacatgaagcgcaagaacattcttttcatcatggccgatcagatggccgcgccaatgttgccgttctacggtccatcgcccatcaagctgccgcatctgagccgtctcgccgcccaaggcgtggtgttcgacgccgcctactgcaacagcccgctgtgcgcgccctcgcgtttcaccctggtcagcggccagttgccgagcaagatcggcgcctatgacaacgccgccgacttccccgccgatgtcccgacctacgcccattacctgcgccgcctgggctaccgcaccgcgctgtcgggcaagatgcatttctgcggcccggaccagctgcacggttacgaagaacgcctgaccagcgatatctatccggccgactatggctgggcggtgaactgggacgaaccggacgtgcgcccgagctggtaccacaacatgtcttcggtgctgcaggccgggccatgcgtgcgcaccaaccagctggatttcgacgaagaggtggtgttcaaggcccgccagtacctgttcgatcacattcgcgaagacggcgaccagccgttctgcctgaccgtgtcgatgacccacccccacgacccgtacaccattcccaaggccttctgggacctgtaccgcgacgaggatattccgctgccgcagaccccggcccagaccgcgctcgacccgcattcccaacgcctgctcaaggtttacgacctgtgggacaagccactgcctgtggataagattcgcgacgcgcgtcgcgcctatttcggtgcatgcagctatatcgacagcaacgtcggcaaactcctggaaaccctggaggaaaccgggctgatcgacgacaccatcattgttttctccggcgaccacggcgacatgctcggcgagcgcggcctctggtacaaaatgcattggttcgaaatggccgcgcgggtgccgctgctggtcagcgcgccggggcagttcgccgccggacgggtaagccaggcggtctcgaccgccgacctgctgccgaccctggtggaactggccggaggccagctgcaaccgggcctggcgctggatggccgctccctggtaccgcacctgcaagggcagggcgggcatgacgaagtcttcggcgaatacatggccgaaggcaccatcagcccgctgatgatgattcgccgcggccgctacaagttcttctacagcgaagacgacccgtgcctgctgttcgatgtggccaacgacccgcgcgagcaggaagaactcagccaatcgccgcaacatcgcccgctattcgaggattttctccgcgaggcgcgggccaagtgggatatcccggccatccaccaacaggtactcgccagccagcgccgccgtcgcttcgtcgcaggcgcgctgagcctgggcaagctgaagagctgggaccaccagccactggtcgacgccagtgcgcaatacatgcgcaaccacatcgacctcgacgatctggagcgcaaggctcgttatccacaaccctgccaaaaccaataacgtaaggggaagagcatgcaaaggttatccacaacagtgacggccgcgcttctggcgctgggcagtgtttcgatcccggcgctggcctgggccgaacagggttgcgagaccgtgaagatggccgacccgggctggagtgacatcgccgccaccaacgccatcgccggtttcctgttggacggcatgggctacaaggccaagatcgacaccctggcggtgccgatcaccttcggcgggctcaaggacggccaggtggatgtgttcctgggcaactggatgccggcgcagcagggcttctacgacaagttcgtggccaatggcgatgtcacccagctggcgaagaacctggacggcaccgagttcaccctggcggtgccggattacgtctgggacgccggcgtgcatgacttcaacgacctgaacaaatacgccgagctacacccaaaagaagtcgacaagaagctctacggcatcggctccggggccccggccaacctgtcgttgcaggagatcatcaagaagaacgacttcaacctcggccagtggaagctgatcgagtccagcgaacaggcgatgctcgccgaagtctcacgggcggtgaaaaggcagaagttcgtcaccttcctcggctggactccgcacccgatgaacgtgcagctgaaaatgcattacctcaagggcggcgagaagtacttcggcgacaccggcagcgtctacaccctgacccgcaaggggtatgcacaggcctgcccgaacgtcggcaagctgctgggcaacctgagcttcacccaggaaatggagaacagcatcatggccgaggtggccaacaagaaggtcagcaactttgacgcagccaaggcctggatcaaggccaacccggcagtgctggacaagtggctggacggggtgaagaccctcgacggcaaggaggcgctgccggcggtgcaggccaagctgtaatccaccacctgtagccgctgccgcaggctgcgatcgacccgcaggggcgcagggttttcgagcccgttgaggtcctgccggacctatcgcagcctgcggcagcggctacaaccgtcactgacgggccttgcacgctccgatctgacactccaccctgacgcctttcgccccatcccgaccgcgaggacccatggcctggcccaatcgccattcactcttgcccttcctgagctggctgccccggcagacccgcgccagcatcgggcgcgacctgctggtgggcctgagcggcgccatcctcgccctgccgcaatcgatcgcctatgccctgatcgccggcctgccaccggaatacggcctgtatgccgccgtcgtcccggtgctgatcgcctgcctctggggttcttcctggcacctgatctgtggcccgaccgcggcgatttccatcgtcctctacgccagcgtcagccccctggcggtgccggcgtcccaggactacatcaccctgatcctgctgctgaccctgctcgccggcctgttccagtggctgctggggctgttgcgcttcggcgcgctggtgaacttcgtgtcccattcggtggtgctcggcttcaccctcggcgccgcggtggtgatcgccctggggcaattgcccaacctgctgggcctggacttgccgagcgaagccaccgcgctgaacagcctgacctcgctgttcgcccatctcgatgccgtggataaaccctcgctgattctcggcctgggcacgctggtcgtcggcctggccctgaagctgctggtgccgcgctggccctcgctgctgatcagcctgatcctcagcgctctggtggtgtggctgtggccggcgctgttcggccaggtaaaactggtcagcgcctttaccggccggctgccgccgttcagcccactgccgctggacctggacatgatcctgcgcctgctgcccagcgccgtggcggtgggcatgctggggctggtgaccagcctgtcaatcgcccgctcgctgtcggcacgctccgaacagttgctcgatgccaaccaggaagtccgcgcccagggcctgtcgaacatcgtcggcgcgtttttctccggttacctgtcgtccggctcgtttacccgctccggcctgagctacgaggccggcgcctgttcacccctggcaggggtgttctcagcattgtgggtggccttgttcgccgtggccggcgcggcgctgatcgcgcatatcccgatcccggccatggccgggagcatcctgctgatctgctggggcctggtggaccatcgcggcattcgcgcgctgttccgggtcagccgcgccgagttcgcggtgatgggcctgacctgtgtcgccaccttgctcctggaattgcagacagcgatctatgccggggtcctggcgtcgctgttcttctacctcaagcgcacctcgcaaccgcgcgtgcagcacggacgcgaaggcgacgaggacatcctgcgggtcggtggctcgatctttttcggcgccagccattacctgcaagtgcgcatgcaacgctgccatgcgccgcgcctagtgatcgacgcccggcagatcaacttcatcgactattccggggtggccatgctgcaccaggaagcccgccgcctgctacggcagaaccgcagcctgaccctgcgtcgcgcgcgggcctcggtgatcgaagagttgagaaagctcgaaggcgcggagcaatgcccgatccggtttgaggattgagccgggcgaagattatgtagaagtgagcttgctcgcgatgaacctcaacaatgatgcgcggtggctgtcacaccaccgcttcgcggctatcgcgagcacgctcctacaatagaaagaaggaagcagtgtcagagcgccagctggcgccgcagctccgccagcaccggcgcggtgtccgggcgcacaccgcgccacaggaagaaggcttccgccgcctgttcggcgagcatgcccaggccatccatggaaatcgccgcgccgtactggctggcccaacgacagaaggcggtcggctccttgccatacatcatgtcgtagcacaccgtctggcccggctcgatcaggctggcggcgatcggcggcacgtcgccggtgaggctggccgaggtggcgttgatgatcaggtccaccggctcgcgcagccagtcgaaaccactggccgacaccggccccaggtcgctgaacagctccgccagcagctcggccttttccaccgtgcggttggcgatgatcagcgacgccggctgttccgccagcagcggctccagcgcgccacgcaccgcgccgccggcccccagcagcagaatgcgcttgcccttgaggctgaagccggcgttgaccgtcaggtcgcgcaccaggccggcgccgtcggtgttgtcgcccaacaggctgccatcggcgagcttgctcaaggtattcaccgcgccggcgcgctgggcgcgggcggtcaggctgtcggccaggcggtaggcctcctccttgaacggcaccgtgacattggcgccacgcccatccatgaagaatccgcgggcacaaccggagaaatcgtcgaggggcgccagcagggtggtgtagaccagccgctgcgccgtctgctcggcgaacagccgatgaatcagcggcgacttgctgtggccgatcgggttaccaaaaacgacgtactgatccatccaataaaaccctcatgcacatccctgtaaggaaccagcttgctggcgacagggacgctgcgctgttctgttcaatcgcattatcgtccagcgccggccagccggctgcaacgctttacgcagagcccgccagccagtcgcggtcctgcaggaaatattcggtcaggcgcgcttcttcgctgcccggctcggctttccagtcgtagccccagcgcacctgcggcggcagggacatgaggatcgactcggtacgcccgcccgattgcaggccgaacagggtgcctcgatcgtagaccaggttgaactcgacataacggccgcgacggtattcctggaactcgcgctgcttctcggtatagcccagggccttgcggcgctggacgatcggcaggtaggcctcgaggtaggcgtcgccgatggcgcgcatgaaggcgaagctggtgtcgaagtcccactcgttgaggtcgtcgaagaacaggccgccgatgccgcgcggttcattgcgatgcttgatgtggaagtagctgtcgcaccaggccttgtagcgcgggtagacgtccgggccgaagggcgcgcaagccttttgtgcgacgcggtgccagtgcacgcagtcttcctcgttggcgtagtagggggtcaggtcgaaaccgccgccgaaccaccagaccggctcttcgcctgccttttcggcgatgaagaaccttacgttggcgtgggaagtcggcacatgcggattgtgcgggtggatcaccagcgacacgcccagcgcctcgaaaccacggccggccagttccggccggtgggcgctggcggacggcggcaagccgctgccaaacacgtgggagaagttgacgccgcctttctcgatcaccgtaccgtcggcaatcacccgggtgcgcccgccaccgccggccggtcgggtccaggcgtcttcgacgaagcgcgtaccgccgtcttcggcttccagggcggcgcaaatacggtcttgcaggtcgagcaggtaggcttttacggcctcggtgcgggtagtcatggcatcaccttgaatcgggcaaagctacgcggcgccagggatacagcggggggcctgcgcaaatgggcgcgtagcataacaccgcacaggggccggtcgcagttgacggcggtcaagcataggagtccgataaggcactttcgcgacacgaccgaggagagagtgcagatggccaaacgtatccagttccgtgcccatggcggcccggaagtgcttgagtatgtggattaccaacccgccgaaccgggcccgcaacaggtccgcgtgagcaacaaggccatcggcctgaacttcatcgacacctactaccgcagcggcctctacgcgccaccggccttgccatcgggcctgggcgccgaaggggccggggtggtcgagacggtgggcagcgccgtgacccgcttcaaggtcggcgatcgagtggcctatggcagcggcccgctgggcgcctacagcgaagtgcatgtgctgcccgcggacaatttggtgcacctgccggacagcatcagcttcgaacaggcggccggagtgatgctcaagggcctgaccgtgcagtacctgctgcgccagacctacgaactcaagggcggcgagaccgtgctgttccacgccgccgccggcggggtcgggctgctcgcctgccagtgggccaaggccctgggggtgaagctgatcggtaccgtcagctcgccgcagaaagccgcgctggcgaaatccctcggtgcctgggaaaccatcgactacagccatgaagacgtggccaagcgcgtgctggaactgaccgacggcaagaaatgcccggtggtctacgacggcgtgggcaaggacacctggctgacctcgctggactgcctgcaaccgcggggcctgatggtcagcttcggcaacgcctcgggcgcggtggagggggtcaacctgggcatcctggcggccaagggctcgctgtacgtcacccgtccgaccctgggcacctacgccaacaacgccgagaacctgcaggccatggccgacgatctgttcgccatgatcgccagcggcaagctgaagatcgagatcggccagcgttatccgctggcggaagcagcgaaggcgcagaccgaactggcggcgcgacgcaccacgggttcgaccattctgttgccttgaaatgcatcgcgggcggcgatccggcttgcccgcgataaacgctgacgcggtgtcaggccggacgcacgatcttgccggtcaccaggtcgcggatcaggctcgggttcttgcgcccgcccaggctgccgcccaggaccatgtccagctccccgcggaaatactgctcgacgcgaatccgcgtgcgggccgcagggcgtccctgagggttggccgaggtggaaatcagcggccccaccaaggcgcacaactcacgcaccagtggatgatcgctgactcgcagggccacggtgtcgtggaccccggtgacccattccggcaacagattctgatgggggaccagccaggtgttcgggcccggccaagtgctggccatgcgatcgagccattcctgggggaaatcctcgaagagaaaatcgaactggcggatgttgtcggcgatcaggatcaggcccttgtccacggagcgcgacttgatggccagcaaccgatccaccgcctcttcgttccacgggtcgcaacccaacccccagactgcttcggttggataggcaatcaccgcccctgcgcgaatttctcgtgcggcttgttgcacacgccaactgctgaccattgctgactctccggattaaggctgtgcgcagtttaccgatcctgcctataaaacctagccttttgcccgggcgaaccagcaaccgccctcgcagacaacatggccctccagctccagttcggtgagcgccgccagcaccctgggcaggctccagccactggcctgcaccaggccctcgctggtctgcggcgcggcatgcaacagcgccagcaacgggtgagcgggcgcggctgttggcggggctgtggataacggcagccgttgccagccacgcagggcttcgaggatatgttcgatggtttccaccagcaccgcgccatcgcgaatcagctgatgacagccccgggctccggggtgatggatcgacccgggtatcgcatacacctcgcggccttgctcggcggcgagccgggcggtgatcagcgaaccactggcgacgctggcctccaccaccagcacgccaagggacaggccgctgatgatccggttgcgccggggaaagtggctggcgtggggcccggtctccagcgggaactcggaaaccagcgcgctgccctgggcgatcatggcatcggccaggcgccggttgcgctgtggataaaatttttccaggccggtgccgagcacgccgacggtctgcccgccaacctccagagcggcctggtgcgccgcgccatcgatccccagcgccaggccgctggtgatgacaaaaccggccgcggccaggctgcgggaaaaggccgcggcggtgtccatcccgggccgcgaagcgcgacgactgccgaccaccgccaactgcggtttttccaggatgcgtgggtcgccagcgacaaacagcagcggtggcgcatcggcgatttcattcaacagcggcgggtagtcaggctggtcccacatcagtaaatgctggcccggacgctccagccaggccaatgcatggctggcgccatcacgcacttcggcattgcgccgggcctcggccgcgcccgtcggcaggcccagcgcgcgccaggcgctggccggtgcgctgatggccttggaggccgaaccgaaggcttcgagcagcagctgaaaacgcttcgggccgaggtccggcaagcggtgcaaacgtagacgggcttccagttccgcgggggaaaccggagcctgggcaggcagtgacatgggatcatccttgatcgttataagcccggtcgcagctggaataagctgtggataactctgttggtaacttgttgagggtttttacgggttacgcaccttgtccatgatcgccagggaacgggaagcattgagcaccaggccgtaactgagcttgtcgtaggtgcggaaaaccatcagcagaccggcccgctcatccggcatcttcacttgtccaccggctacccggtcgcgcacggtttcgccggttttcattaccgccagcacgtcgccttcagccaggccatcgcgccgtcccttgttcaacgtcaccacatccaacgcaccgatctgggtgacaccccgtggcacgtcgatgatcaggccttcgaccgcccggctcggcgcgctggggaaaaaggtcgagttgatgacccgcggctcgccgccgaacaggcggtcgcccaggcgcacttcctgggtggtgcgctgcaattgcagggtggcgatatcgccctcgaccgcgaccacctcgccgccgccgatttcgtcagcattgatccccagtacttcgccgctctgcgggtcggtgtaggtcttgccctggcggaagatgccgtaggccgattgctccgggtcgaagcggccgcgcgcgaagatccggtcgccagtgccgctgagtacccgttcggcatcgccggcgactatgtagggtgcgctgtcgaaggtgtcggcccggtcgaggatgcggttgctcagcagaaagctgtcgatggcctgcagtggaatgctcgggatcgcctcggccaccggcgtgcggcgcacctggggcgagagcttgacagtgccccgggaagcgccgcgctccagggtcaggtgtggttcgccatcgacccggaccagcgccagggagtcgccggggtagatcaggtcggggtcggcgaggctggaattggcctgccagagcgccggccattgccagggatcgcgcagaaagcggctggcgatgctccacaaggtatcgcccgccactacggtgtagcgctgtggataaccctcccggagcggcacctgcgcctggccgaaaccggcccagcccacgagcagcaaggcgagtagtgatttcctcatgcggtgaatccctttattatgtgtattcgcgtgaaacgccagcgcctgtgcgctccctgctcctgaccgagcacgttttacaacggttgcccttccagaacccgcaaggcctccgactccgaacttacttcacacgtgtagcaattacgcttatggccattttaaacatcctcgaattccccgactcgcgcctgcgcactatcgccaaaccagtggccgtagtggacgacgaagtgcgtcagttggtcgacgacatgtttgaaacaatgtatgaggcgcccggcatcggcctggccgctacccaggtcaacgtgcacaagcgcatcgtggtcatggacctgtccgaagaccgcagcgagccgcgggtgttcatcaaccccgagttcgaagcgctcaccgacgaaatgggccagtaccaggaaggctgcctgtcggtaccaggcttctacgagaacgtcgatcgtccgcaacgcgtgaaaatcaaggccctggaccgtgacggccaaccttacgaactgatcgccgaaggcctgctcgcggtgtgcatccagcacgaatgcgaccacctcaacggcaaattgttcgtcgattacctgtccacgctcaaacgcgaccggatcaagaagaagctggaaaagcagcatcgtcagcaagcttgattcccttcttccaaaggcttgcagcggcaagcctttttcttttccgcgtgtttattaccgagaactcccatgactgagccactgcgcatcgtctttgccggcaccccggaattcgccgccgaacacctcaaggccctgctcgacagcccttatgagatcgtcgcggtctacacccagccggaccgcccggccgggcgcgggcaaaagctgatgccgagcccggtcaagcaactggcgctggagcacgacatccccgtgctgcaaccgccgaccctgcgcgacccgcaagcccaggccgaactggcggccctcgcgccggacctgatggtggtggtcgcctacggcctgatcctgccgcagacggtgctggatattccgcgcctgggctgcatcaacagccacgcctcgctgctgccacgctggcgcggggcggcgccgatccagcgcgccgtggaagccggcgacgccgagagcggcgtgaccgtgatgcgcatggaagccggcctggacaccgggccgatgctgctcaaggtcagcaccccgatcagcgccaccgacaccggcggcagcctgcatgaccgtctcgccgaaatgggcccaccggccgtggtgcaggccatcgccggcctcgccaccgcaaccctgcaaggcgaagtgcaggacgacagcctggccacctacgcccacaagctgaacaaggacgaagcgcggatcgactggagccgcccggcggtagaactggaacgcctggtacgggccttcaacccctggccgatctgccacagcacgctgaacggcgaagcgctgaaggtgctggccgccagcctcgccgaaggcaagggcgcaccggggaccatcctcggcgccagcaaggacggcctgctcgtcgcttgcggtgagcaggcgctgtgcctgacccgcctgcaattgcccggcggcaaggcgctgaacttcagcgacctgttcaacagccgtcgcgagaaattcgccaccggcaccgtgctcggacaaacggcggacgcccaatgaacccgcgtctggccgccgccaaggccctgacctcggtcctcaacggcaaagcctcgctcaacagctcgctgccaaccctgctggacaaggtcgaagcgcgcgatcgcggcttcacccaggacctggctttcggcaccgcgcgctggcagccacggctggcggcgctggccgccaagctgttgcagaagccgttcaaggcggccgatgccgacgtcgaggcgctgctgctggtgggcctctatcagttgctctatacccgcgtcccggcgcacgccgccatcggcgaaaccgtgggctgcgccgacaagctgaaaaagccctgggccaaggcactgatcaacgccgtgctgcgccgcgcccaacgcgagagcgaagcgctgttcgccgagctggaacgcgacccggtggtgcgtaccgcccatccgcgctggctgcaaaagtccctcaaggcattctggcccgagcagtgggaagccatctgcgccgccaacaacgcccatccgccgatgatcctgcgggtcaatcgccgccaccattcccgcgccgcttacctccagctgctgagcgaggccggcgttgccgccaagccttgcgtctacagccaggacggcatcgtcctcgatgaagccgccgacgtgcgcgccctgccgggcttcgccgaaggctggatcagcgtgcaggacgaggccgcgcaactggccgccgagctgctggaactggcgccgggacagcgggtgctggacgcctgctgcgcgcccggcggcaagacctgccacatcctcgaagtcgagcccgcgctggccggcgtggtcgcggtggacctggaagccaagcgcctggtgcgcgtccaggagaacctcgaccgcctggggctgaacgccgagctgatcgccgccgacggccgcgacaccgccgcctggtgggacggcaagccgttccagcgcatcctgctggacgcaccgtgctcggccaccggggtgatccgccgccacccggatatcaagctcacccgtcaggccgacgacatcgccgccctggccagcctgcaaggcgaactgctggacgccatgtggtcgaccctggaagtcggcggcatcctgctgtacgccacctgctcgaccttgccgaccgaaaacaccgaggtcatcgaggctttcctggcccgtaccccgggtgctcgcgaactggacatcgccgggcaactgggtcagcctccggccggcctgaagcaaccccacggtcgccagctgctggcgcaagagggcggccacgacgggttctactacgccaagctgatcaagattgccgccgcgcgcggttaagaaaggttcgaagggagtgactggatgaagatcatcatcctcggagcagggcaggtgggcggttccctggcggaacatctggccagcgaagccaacgacatcacggtggtcgacaccgacggcgatcgcctgcgcgatctcggcgaccgcctggacatccgcaccgtacagggccgcggttcgttccccacggtactgcgccaggccggcgccgacgatgccgacatgctggtcgcggtgaccaatagcgacgaaaccaacatggtcgcctgccaggtcgcccataccctgttccacaccccgaccaagatcgcccgggttcgcgaagcggcctacctgacccgcgccggcctgttcgacaacgaggcgattccggtcgacgtgctgatcagcccggaacaggtggtgaccaactacatcaagcgcctgatcgaacaccccggcgccctgcaggtgatcgacttcgccgaaggcaaggcccagctggtggcggtcagggcctattacggcgggccgctggtggggcagcaactgcgccagctgcgcgagcacatgcccaatgtcgacacccgcgtcgcggcgatcttccgccgtgaccggccgatcctgccccagggcgatacggtgatcgaggccgacgacgaagtgttcttcatcgccgccaaggccaacatccgcgcggtgatgagcgagatgcgccgcctcgacgaatcctacaaacgcatcgtcatcgccggcggcgggcagatcggcgaacgcctggccgaagccatcgaaagccgttaccaggtgaagatcatcgagatgaacccggcgcgttgccgctacctctcggacaacctcgacagcaccgtggtcctgcaaggcagcgcctcggaccgcgacctgctgatggaagagaacatcgccgacgccgatatcttcctggccctgaccaacgacgacgaggccaacatcatgtcctcgctcctggccaagcgcctgggggcgaagaaggtgatgaccatcatcaacaacccggcctatgtcgacctgatccagggcggcgatatcgatatcgccatcagcccgcagttggccaccatcggcaccctgctggcccacgtgcgccgtggcgatatcgtcagcgtgcactcgctgcgccgtggcgcggcggaagccatcgaggcgattgcccatggcgatgccaaatcgagcaaggtgatcggccgcgccatcgaggacattacgctgccgccaggcaccaccatcggcgcgatcatccgcgacgaggaagtgctgatcgcccacgacgacacggtgatcgaagccggcgaccacgtgattctgttcctggtggataaaaaacatatccgcgatgtggagaagctgttccacgtgggcttgagcttcttctgatccgggacctgcgctgtcaggaccggccaatcgcgagcaagctcgctcctacaatgagagacgtacatccctgtaggagcgagcttgctcgcgatagctgtctcgaatacgccacataaccgtcgaaggaaccctccccatgctcgaatccctggaaaaaatgctcgccaagggcatggataactcgctgctgcgcttcggcctgggcaaggggtatctggatctgcacgaatacgccaaggccgccgaacacctgcaacgctgcgtcggtttcgaccccaagtattcggcggcgtggaagctgctgggcaaggcctatcaaggcctggaagattatccagcggcgcaccaggcctgggagcagggcctggaagcagcccgcgggcatggcgacaagcaggcagaaaaggaaatgacggtgttcctcaagaagctcgagcgccagggcaaaggcggactgtagccgctgccgagtgagcgaggctgcgtacgaggacgtagtcctcgctaaacctgaacaccgggattgtcaggcgaatcgcagcgcctggtcttgcgaccgcttcgcggccgatcgcagcctcgcaagctcggcagcggctacagaggcaatgtccggacgcatcacaggtaacgcagaccgatgccctcggcgtccaccagcaccacctccatcttcacccgcggcgcgttcatcggcaggccttgcacctggccgtagaccaccgcgcccttgggcagcgccgccaatgccgggtgcttgacgtacaccccgctggcggacagattgcgcgtctgccccaggcactcgccgaagctttcgtgctggatcttgatcctcagggatttgcgcgaatcgggcatatgctgtgctctgcttcagcctttgtggataaccttgggcgaaaggttatccacagatcgtgccaggcggtcagtaccagcgttcttcgccgggcggacgtttcttgaaacgcttcatgctccacatgtactggctcggataagcccgcacatagcgctcgaccacctggctcatcgccgcgcaggaggtttcggtgtcggtgctgtacatcgcgtccggcgcggcttcgaggatcaccttgtagcccgaaccgtcgggcaggcgcagcgcatgcaggaacaccccaaccgccttgccgccggcgagcatgttcggcacgaacttgctggtcagcgcctgggtggcgaagaagggcacgaagatcccggcggattcggccggttccgggtcggcgggaatgcccaccgccccccctttgcgcacttccttgatgacactgaggatgccttccttggtcgaggccgccacccggttgcccagctggacccgctgcttgcgcagcagttcgtccaccgccttgagcttcggtgggcggtagaaaatgatcggtttgcactggctgcaatagaagtggttgagcacttcccagttgcccaggtggctggtgatgccgaccacgcccttgcccgacgccagcgcttcttgcagcacctcgaggccctcgacttcacgcaccagggcgatcgaacgctcggccggccagatccaggcgcaggcgctttcagtcagggacttgccgatatctttcaggctctgtcccactaaacgctcgcgctcggcggcgtccatctgcggaaagcacttggccaggttgatccgcaccacatcgcgggaacggttgggggtcttccacatgatccagccgatggccgaaccgaccgcctgcaccgcgcgccagggcagcagggcaaacaatcgcagagcgcctaccagcagggcgcctttaaacttatccacaggtgactcctgatatccgggtcatgaaccttgtcgcaagccggctattctaaccggccatcacaggctgtgtgaaaacgtcgcgagtgaaggcaagacaaggcaaaaacaggcgaggaagcggagtttaggggcctaaatgagcattccgagcctgtttttaacgccgtattgccgaacgcagcagttttcacacagcctgtggagcgaggatggcgtagcgatcgcagtcgcgggtgtgatccatgaccatgcccgaagcctgcatcagcgcataacagatggtcggcccgacaaaggtgaagccggcctttttcaggcccttgctcatcgcctcggcctctggagtcaccgccgggacttcgctgcgatccttgaaatgattgattttcggcaccccgccgacgaacgaccagaggaattccaccgggtcttccagcgccatccaggcctgggcgttgcgccgggcggcagcgagtttgagacggttgcggatgattccgggatcgagcatcaactcgtcgatttgtgcatcgctcatctgcgccacgcgctgcacatcgaagccgaacagcacctggcgataacgctcgcgcttcttcaggacggtgatccaggacaggccggcctggaacccttcgagcaataacaactcgaacaaacgctgcgcatcgcgtagcggcacgccccactcctgatcgtggtacgccatgtacaggggatcttcgttgcaccaaaagcagcgtggcataaggctccagtgggcgtgcgcacaactgaatcgggtatactcccgctctttaaatcgcagcccaagtaacaggtgaatttcgtgagccagcctacgccagccgtgcgtaccttccaagacttgatcctcgccctccagcaatactgggccgagcaaggttgtgtggtacttcagccctacgatatggaagtaggcgccggcactttccataccgccacgttcctgcgcgccatcggcccggaaacctggaacgccgcttatgtgcagcccagtcgtcgcccgactgacggccgctacggcgaaaacccgaaccgtctgcagcactactaccagttccaggtggtcttgaagccgaacccggaaaacttccaggagctgtacttgggctcgctcaagcacgtcggcctcgacccgctggtgcacgacatccgtttcgtcgaagacaactgggaatcgccgaccctcggcgcctggggcctgggctgggaagtctggctcaacggcatggaagtgactcagttcacctacttccagcaagccggtggcatcgagtgctacccggtgaccggcgagatcacctacggcctggaacgcctggccatgtacctgcagggcgtggattcggtctacgacctggtctgggccgacggtccgttcggcaaggtgacctacggcgacgtgttccaccagaacgaagtggagcagtcgacctacaacttcgaacatgccaacgtcgagaagctgttcgaactgttcgatttctatgaaagcgaagccaagcgcctgatcgagctggatcagccgctgccgttgccgagctatgaaatggtcctcaaggcctcgcacaccttcaacctgctggatgcccgtcgcgcgatctccgtgaccgcgcgccagcagtacatcctgcgtgtgcgcaccctggcgcgttccgtcgcgcaagcctacctgctggcccgcgccaagctgggcttcccgatggcaaccgaggatttgcgtgatgaagtgttggctaagttggaggcggcacaatgagtgcgcaagattttctggttgaactgggcactgaagaactgccacccaaagccctgaacaccctggccgaagccttcctgggcggtatcgaaaaaggcctgcaggccgccggcctgaacttcgagaccaagcacgtctacgccgcaccacgccgcctggcggtgctgatcagcggcctggccacccagcagccggatcgcagcatcaacctcgacggcccaccgcgccaggccgccttcgacgccgaaggcaacccgacccaggccgccctgggcttcgccaagaaatgtggcgtggaactgagcgaaatcgaccagagcgggccgaagctgcgctacagccaaagcatcaagggcaagccgaccgccagcctgctgccgaccatcgtcgaagactcgctgaacgacctgccgattccgaaacgcatgcgttgggctgcgcgcaaggaagagttcgtgcgtccgacccaatggctggtgatgctgctcggtgaccaggtcatcgactgcaccatcctcgcccagaaagccggtcgcgactcccgtggccaccgcttccatcacccgcaaagcgtgcgcatcacctcgccggccaactacctggacgacctgcgcgccgcctacgtgctggccgacgccaacgagcgtcgcgagctgatcagcaagcgcaccgaagaactggcgcgcctgcaggaaggcaccgccatcgttccagctgatctgctggacgaagtgaccgccctggtggaatggccggtgccgctggtgtgctcgttcgaggagcgtttcctcgaagtgccgcaggaagccctgatcaccaccatgcaggacaaccagaaatacttctgcctgctggacgtcgacggcaagctgctgccgcgtttcatcaccgtggccaacatcgaaagcaaggacccgcgccagatcatcgagggcaacgagaaagtcgttcgcccacgcctgaccgacgccgagttcttcttcaagcaggacaagaaacagaagctcgaagacttcaaccagcgcctgcagaacgtggtgttccaggagaagctgggcagcgtctacgacaaggccgagcgcgtctcgaaactggccgcgttcatcgccccgcgcatcggcggcgacgcccagcgtgccgcgcgcgcgggcctgctgtcgaagtgcgacctggccaccgaaatggtcggcgagttcccggaaatgcaaggcatcgccggttactactacgccctcaatgacggcgagccggaagacgtcgccctggcgctgaacgagcagtacatgccgcgtggcgccggcgccgagctgccaagcaccgtcaccggtgccgccgtggccatcgccgacaagctcgacaccctggtcggcatcttcggcatcggcatgctgccaaccggcagcaaggacccgtacgcgctgcgtcgtgccgcgctgggcgtgctgcgcatcctgatcgacaagaagctcgacctggacctgacggaagccgtggcgttcgccgtcagcgcgttcggcagcaaggtcaagagcgccggcctggccgatcaggtcctggagttcatcttcgaccgtctgcgtgcgcgttacgaagacgaaggcgtggatgttgccacctacctgtcggtccgtgccctgaagccgggttcggccctggacttcgaccagcgcgtgcaggccgtgcaggccttccgcaagctgccggaagccgccgcattggccgcggtgaacaagcgcgtctcgaacctgctgagcaaggtcgaaggcagcgtgccgaccaccgtggaagccaagtacttcgataacgccaacgagttctccctgtactcggcgatccagcaagcggaccaggccgtgcagccaatggccgcggcgcgccagtacagcgagaccctggcccgcctggccgccctgcgcgagccggtcgacgccttcttcgagaaggtgatggtcaacgccgaagacgccaacgtgcgggccaaccgctacgcgctgctggcacgtctgcgaggtctgttcctcggtgtcgccgacatctcgttgctggggtaaggcgtacgtgaaactgctgattctcgatcgggacggagtgatcaattacgactccgacgcttacatcaaatcggtggaggagtggattccgctccccggctcggtcgaagccatcgcgcagttgagcaaggccggctggacggtagcggtcgctaccaaccagtcgggcatcgctcgcggttactacgatgtcgccaccctcgacgccatgcacgagcgcctgcgcgctctggtggccgagcagggcggcgaactcggcctcatcgtgtactgcccccatggcccggacgaaggttgcgcctgccgcaaacccaagcccggcatgttgcagaccattgcccggcactacgcagtggatctggctggtctatggtttgtgggcgacagtctcggtgacctggaagccgcaaaagccgtcgactctcagccagttttggtaaagaccgggaagggcgaaaagaccctggggaaaaccctaccggtaggcaccttgatttttgacgacctggcggcagttgccgctgaacttatccacaattagagtccttctgagatcctgaccaaggattgttcgggagtgcgcttttttagaggcgggcaatgcccgcaacggtaaacgccgctatgtcgatcctgcaggcaatcagaaccttcttcttttacctgctgctgggcaccagttcgttgctgtggtgctccctgagcttttttatcgcgcccttcctgccgttcaaggcgcgctatcgctttatcaacgtctattggtgccgctgcgcattgtggctgaccaaggtgtttctcaagatcaacgtggaagtgaagggtgcggaaaacatccccgagcgcccttgcgtgatcgtctcgaaccaccagagcacctgggagacgttctttctctcggcctatttcgaaccgctgagccaggtgctcaagcgggagctgctgtatgtaccgttcttcggctgggccatggccatgctgcgtccgatcgccatcgaccgcgacaatcccaaggccgcgctcaagcaggtcgccagcaagggcgacgagctgctcaaggacaatgtctgggtactgatcttcccggaaggcacccgggtgccttacggccagatgggcaagttctcccgcagcggcagcgccctggcggtcaatgccgacttgccggtgctgccggtagcgcacaacgccggcaaatactggccgaagaccggctgggtcaggcaccccggcaccatcaccgtggtgatcggtgcgccgatgtacgccgaaggctccggaccacgggccatcgccgagctcaacgaccgggtcgcggcctggaatgagcaggcgcagcgggacatgggttcgctgcctccggtagccgcggctccggacaaaatggccatctgagtttctgtggataacctgtgtaccgttttattggaaatcgctatatcaaatccataactagatgatttatatacatatttcataaacccataaaataccagaaaaggtgcataagttttctggatacgaaaaaaccggcctggagccggtttttttcgcctatcgatattcagtccgtgagcagaggtaattgcaggctgaaggtcgtcccctcgccgaccacgctacggcagacaatccgcccttcatgccggtcgaccaccgccttgaccatcgacaaccccagccccaggccttcgctgccctgcgccgaggcgaagcgctggtactgcacgaacaactgcggcagttcatcggccgcaatgcctttgccctggtcggtgatatcgcaggtcagccagccttccgtacacgcaacttgcacccggacagtcgagcccgacgggctgtacttgatggcgttttccagcaggttgaacaaggcccgggtcagcagggactgatcggccagcaccatgccttcggcatcgtcgtcgaggtcatgcaccagctggatgtttttcagctgggcgatggtcatggcctggtcgaacgcatccagcaccagcatggcgaacatgctcggctggaactgataggcctcggactcggccttcgccagttgcacgaaggcttcggtgagccccagggcgcgacgcacctggagttcgatctggctgtagatccgcgtgtcgcccgagccctggtgccgctgtacatcgagcaaggccaggatcgccgaatgaggcgcgcgcaggtcatgggacaggaagcgcaacagggtggcccgctgctgttcggcgtctcgttccaggctcaggtcggtgaggctcagcagccagccgatcggcgtatcgctgtcgatcggcagcaagggcgccaggtccacccgcaggctgcgctgctcgatatcgcgaaactccacaggctgcagctgcgacagggcagggcgttgcccatcctgcaaaccgggataacccaggccggccaactggtggaccaagtcctcgccgatcagcgcgttgccgaacacttcgcgagcattgcggttggccagcaacacgcggccgtccggatcgctgatcagggtggccaccggcaggtattccaggccgtcggcaatgaagcggcgggtgtcgcgggtgcggctcaatgcctgctccagggccacgatctgcccctgcagtacatcccctgcaggagcctgggtgcgtcggcgctcgggcagcaccttaggctcgctgtccaggcgtgccagctcccagccgaagtaggccaggatcacgctcaggcggcgccagttccagatcaggtaggccagcagcatccccaacaggctggccaccggcggccaccacagccccaggcgcagcagcccggccgagccgagcagggcagccgccatgcaggccagggtcagccacaatgcatgccgcggccgcaccagcagcaatcccagcaaggccgccaccagcagcaccgacagcgccgcgaccggccattgtccgagggcgacgatggtgcgctgctgcaacaagccattgagcaggttggcctggatctcgatacctggggtggtgccgacactggccgactgcggggtgacatagcggtcgcccaggccgggcgcggtagtgccgatcaggatcagcttgtcgcgcaacagctccggcgggacttcgccgcgcaatacgctgacatagggaacactggggaaaccggcatggggactgatgaaggggatgcgtactgggttgctgcgcagccagccctgggcgatctgcgcggtgtccgaaccgggcatcgacagggccgtgcccgggtatgactgttgataaagcagccaggccagttgcgccttcggtgcctgcggtgggccttcgcgcagatagacgctgcgaaccgtgccgtcggcgtcggcctcggcattgatatggccgaccgccttggcgcactgactcaacggcggcaccggttcgatctcacccagcggctggccgtagcgggccacgctctcgcgcagcaggggcaggaataccttgccctcgcggcagaccgcctgggccagtcgttgatcgttttcgggaatgctgtcgggttcgctgaagatcacgtcgaacaacacaccctggaccttggctgccgtcagccgatccagcaggtcggcgtgcagggtgcgcggccagggccactggcccagctgctgcaggctgtagtcgtcgatggtgatcatcagcagccgcgaatcgaccggcagcgggctgagccgccgcaggttgtcatacagcaggttattcagcgccagcccgtggctcaacgacagcagggcggtcaagggcagcaggatcaggctgacccatgcccattcccgcaccagaccgccaaacagtcgctgggcttgcgtcggctcccggccctcgggtcggcgccagcgcctcaccgacaaaccgccgcgcacttactgaacacgcgtggtcctggggtaatagaagatgtcatagacgcccgtctctccttcgagtccgtgctcatcgaaagcagaaaggcggacatgataaaaaaatgcttccaggccgctgaagttgacttccggcgtgctggagaactgttcctgcttgatattgaggaagcttttgtcagtcgccacctgggcccggtaacgcttggcgcccggcaagggcttcatgatcagttgccagaccggcagatcgcccgtctggcccgcctggcccatcagttgcggcgcgggtaacagatcgactggcttcagcgggccttctttctggatgcgcaaaccctggcgagccatgacctggacttcaccgggaaccggcccgaccggtttatccacagggcgtttcttgccctgggtctttttcggcgcttcgtcgtcttcgcggttgaccgctacctggccgttgagcacttccaccagcgactgctgatcgtcgttacgcacccggaagtgcgtgccgcgtacacccagcacgccgatcggcgtgacgatctggaaacggtcgtaatcgctcgggcgcttgatgacataggattcgatctgcccctgctcgagcgcgacctgggggatcgcatgttcttcgttcaggtgcagggtgatctgggaactggagggcagtaccaccagcgaaccatcgcccagggacaggctgacgaatgccgaaggcgaggtcttcaccccttcgagttcatcgacactcatgcctttttccaggggcacctggttacccttggcatccagcttccaggcttcgcccgtgaggtgctcgaccgtcgccggcaacggctggccacggcattgctggttttcatcgatatagggagggcgcttgggtgctgcaacagcagcctgcaccgtggaaaaggccagtgcgctaccgagaagaaacgacacgagcatggcccggtggcggatgtgcaaggaggtcatgggttcataggtccgtagtcgcgctcttctgaagtccgtgccattagaactgcattgttagcgttctgaccatacctctcgaaccaaggccggccagggtcattcccttacgggacaaacagcacaaccgctggagagcggctgcgctgcttggctccatgccggccggatgcgaatcgacgcatccggccgcacaggtcagtcccgctcgatggagatcaaccgataggccagggctcccagccctgcgcccaacagaggggctacccagaacagccacagctgggacactgcccactcaccggcgaagaaagctaccgcggtgctgcgggccgggttgaccgaggtattggtgaccggaatgctgatcaggtggatcagggtcagcgtcaggccaatggcaatcggagcaaaaccagctggagcacgcttggcggtggcacccaggatgatcaggaggaacatcgccgtgagcacaacttcggtcaacaacgcagcaaacatcgagtagccaccaggcgagtgctcaccatagccattggccgcgaagcccgccgacgcgtcgaaaccgaccttgccggaagcgatcaggaacagcacgccacccgcggcgagtccaccgagaacctgggcgacgatatatggcagcagccggctacccgggaaacgcccactcaaccacaggccaaccgagactgcggggttgaggtgagccccggaaatcggacccaatgcgtaagccatagtcaggacgctcaggccaaaggccagggctacccccagataaccgatcccgaactgcggaacgccggccgccagtacggcgctcccgcacccgcccaggaccaaccagaacgtaccgaaaaactcagcgccgaatgtcttcatcagaggccttcacagataaaaaatgaggagttgtttgttggctggcggcgccgtggggccgcgcgggagaggagggatgacacatccctgtgtcgaagcattacgtcctgaggaggcactccctgtattcccctgtactgcaaatcgaggccaggcctcggtctgacgcccgccaatccggcggttgacactccctgtgtcggagcacttccgaatgcccctgtgtgccactcagcgactacgaatttaccggcatggtgtggaggccgggccggtttgcaatatttgttcagaattgtctgatctagaacacccaacgctgctgctcctgatagaccattggctgggtcatctgtggcgcgctgatcggagcgaatccctgggaatcgctgaacccgatagtggttacggacggactgaaatagcgctgcaccggcaaggcgtagtccgaagacggcagcgcgggctgctccgcggtcgaccccaagcccaggcaagccgcgagcatcagtgtggtaaatcgagccaggcccgctgcccgcgcaatgcctgcgtagagcaaccgctccttccccagaatgttccccatagtccttttcctcgcacattcgagccggtatcgttctgcaatgaatgcaggccggatggacagtactcctgtcggctaccggctatatgacatcagcgtatcgagcaaaggtatgaaccagagcaattcgccacaattgttcagattcgtctgatcagcctaaactcagcgccaggtaaggcctcaaataaagccatcagcattctctcgcgataaaaggaactgccccgcatgcgtgtcgcaatactggatgacgagcccgccgaactggcgcgggtggaacagacactgcgacagatccccggccccggggaacagccatggacgctgcacagcttcgaacgtggcgaggacctgctgcggcagctgcggcgcgaaaccttcgacctgctgattctcgactggcagctgccggacctcagcggactgtcgttgctgcgctggacccgtgaacacatggaggcgccaccggcggccatcatgctcaccagccgcgatgccgagagcgatatcgtccaggccctgaacaccggtgccgacgactatgtgagcaaacctttccgccccaacgaactcaaggcacgggtaaccgccgtcctgcggcgtcacggcttgcagcgatcggcagccgtcgaggtgcaaaccttcaacgacctggccttcgatgacgccgagctgaccgtgacccgagccggcagcccgatcagcctcaccgaacgcgagtaccgcttggcccgctgcctgttcgccaacctgggtcggccgttatcccgggagtacctttacgaacgtttctggacccatgaggaaatcgtctcctcccgtcccctggacactcacatctaccgcttgcgcaacaagctggggttgactgcggatcgtggctggcagttgctgaccatctatggttatggctatcgcctggaaagtgtttcagcggccgagtagggcgcctctttttaccaggcaataaaaaaggttcttcacggaatcccgggaaacacagaaacaagaacgccgatttgattgatgatgttcgtgcgagcaaacacatctaacaaaccggcgttcttatgcgtgatattaatactttccttcccttttgggagggcttttctgtcgtcacgatcaagcctgatggtgacgcgctccagatcgatctgattccccacgccacccgattcccttcctgtggcggctgccaaaaactctgttcaaccacgcatgagtactgccagcgagtcatccgcgatctgcccattcttggccgagcagtgcgcctcagcgttttgcttcggcgtgtcggctgtcgggactgtggcaaacgcatggaggccgtcagttggctggatcgctatgcccgcatgacgcgccgcctggccgatgcggtcattcaggcctgcgagcgccttcccacgctacacgtggcccaactgttcgggttgcattgggacagcgttcgcttgctggaacgtcgcgccttgcaagcggcattgagtgttttgccaaaggcgcagccacagcgcttggtcatggacgaatttgccctgttcaaaggtcatcgttacgccagcgtagtgctggacgccgatacccggcgagtgctgtggattggcgaaggccgcagccgggcggcagtcagaccctttttcgaagagctggggtcagagggttgcgctcgcatcgaagcggtggcgatggacatgaacactgcctttgacctggaggttcgtcagcactgcccaaaagcgcgcgtggtctacgacctcttccatgtggtggccaagtatggtcgagaggtgattgatcgagtccgcgtcgatgaagcgaatcggctacgtcacgacaagcctgcccgcacggtcatcaagcaggcgcgatggctgttgctgcgcaatcggcagaacctgaaaacgccggaacaacaagtccgcctggaggatctgctggcggccaaccaagcgttgatgacggtctatttgatgaaggctgaactcaaaacgctttggacaccgagcaccgcctggggctggcgatcagcctggcgacaatggctgcgccatgcgcatgaaagcgacataccgcctctgatccagtttgccaaacgactgaagggttactggcggggcatcgtcagccgggtgcgctggccaatgcatacgggccagttggaaggcatcaacaatcgaatcaaggtcatcaagcggatggcgtacggttaccgggacagcgaattctttttcatgaagatcaagagcgtctttcccggtaatccgtgaagaaccataaaaaaggccaacgctgagcgttggcctttttcatttcggcgatgcaacccggatcagaagtccaggttggataccgccagggcgttgctttcgatgaagtcacgacgaggctcgaccgcatcacccatcagggtgttgaagatctggtcggcgccgatggcgtcttcgatagtgaccttgagcatgcggcgcacgcttgggtccatggtggtttcccacagctgatccgggttcatctcacccagacctttgtatcgctggatggtatggcgcttggtgctttcggtcatcagccagtccagggcttccttgaactcggtcaccgccttcttgcgctcgccgcgctgaatataagcaccttcgtccagcagggagctcagttgagcgccgagggtgacgacggtcttgtagtcattgctgccgaagaagtcgcggttgaaggtgacgtagttcgacaggccgtgggagatcagttcgacctctggcagccacacattacgttcacggtcttcacgcaggctggccttgtagaccaggccggacttctcgacggtgcgcaggcggacttcatattgggccagccaatcctgcatcgccgcgtgatcggagagttgctccaggctcacggccggcaggtagatgaagtgctcggtcagctcttgagggtagaggcgcgacagacgcttgagggtcttcatgaccatgcggaagtcgttcaccaggcgctccagcgcctcgccggaaatacccggtgcttcttcgttcaggtgcaggctcgcatcttccagggccgactgcgtcatgtactcttccatggcgtcgtcgtctttgatgtattgctcttgcttgcctttcttgaccttgtacagcggcggttgagcgatgtagatgtagccacgctcgatcagctccggcaactgacggaagaagaaggtcaggagtagggtacggatgtgcgaaccgtcgacgtcggcgtcggtcatgatgatgatgttgtgataacgcagcttgtcgatgttgtactcttcgcggccgatgccgcaaccgagtgcagtgatcaaggtgccgacctcttgcgaggaaatcatcttgtcgaagcgcgctttctcgacgttgaggatcttgcccttgagcggcaggatcgcctgggtcttacggttgcgtccctgcttggcggagccgccagcagagtcaccttccaccaggtagagttcggaaagggcagggtctttttcctggcagtccgccagtttgcccggcaggccggcgatatccagcgcgcctttacgacgggtcatctcacgggctttacgcgccgcttcacgggcacgggcggcgtcgagcatcttgccgaccaccagtttggcttcgttcgggttttccagcaggaagtcggagaagtacttacccatttcctgttcgaccgcggtcttcacttcggaagacaccagcttgtctttggtctgggagctgaacttcggatccggcaccttgaccgaaatgatcgcggtcaggccttcgcgggcatcgtcaccggtggtggcgaccttgtgcttcttcgccaggccttcctgctcgatgtagttgttcaggttacgcgtcagcgccgaacggaagcccaccaggtgggtgccgccgtcgcgctgcggaatgttgttggtgaagcactgcaggttctcgttgaagctgtcgttccactgcagggcgatttccacgccgatgccatcttcacgctgcacgttgaagtggaacacctggttgaccgcagtcttgttggtgttcaggtattcaacgaacgcacgcaagccgccttcgtacttgaacagctcttccttgccgctgcgctcgtccttcagaacgataccgacaccggagttgaggaaggacagttcacgaatccgcttggccaggatgtcccagctgaagtggatgttcttgaaggtctcgctggaagccttgaagtgaatctgggtaccggtggtttcgctgtcaccgacgatcgccataggcgcctgaggcacaccgtgaacgtaggtctgttcccagatcttgccactgcggcgaacggtcaggaccagctcttcggacagggcgttcactaccgacacacccacaccgtgcagaccgccggatactttgtaggagttatcgtcgaacttaccgccggcgtgcagcacagtcatgatgacctcggctgcggaaacgccttcttctttatgcacgtctaccgggatgccgcgaccgttgtcacgcacggtaatggattcgtccgggtggatgatgatgctgatgtcgtcgcaatggccggccagagcttcgtcgatcgagttatcgaccacctcgaacaccatatggtgcagaccgctgccatcgtcggtgtcaccaatgtacataccgggacgtttgcgtacggcatccaaacctttcagcactttaatgctgctcgagtcgtacgtgttttcttcgctcatgccttcactcccgatggtcgtgggtctgggtgatacggccctgttccacgtggaacagggcaactggcgtttccgtctgccagccttccctcaataattcgtggtctacacaggtaatgaacacctggcagcgtaagtcttccaacaagcgacaaagtgcgcggcgatgctgctcgtccagttcggacggcaagtcatccaccagataaatacactgaccgcgccgggcctggctgaccaggtgcccctgggcgatccgcaaggcacagaccaccaacttctgctgaccgcgggacaagatgtccgcagcgttgtgtgcgcccaatctgagacgcaaatcagcacgttgggggccggcctgggtatgacccatttgctgatcacgatggagggatgtcgcgagcactgcactgagctctcgctctttatcccaaccacggtaatagctaagcgttaagccctcgagctctaccagctcgctcaaggtccgctcaaagactggtttcaaggctttgatataagcgcggcggtattcatcaatttcagcgctggcctgacacagttccctgtcccaggctgcttgcgaagcggcgtcaagtgtaccatgccgcagccatgagttccgctgccgcagggccttctgcaagcgctgccaggttgacatgaagcggggttccacgtggaacacgccccaatcaaggaactggcgcctgattttcggagcaccttccagcaagcggaaactgtccgggttgatcaactgcaggggcaggatctccgccagttgcgccgcgctgcgggcgttctgcccatcgatacggatctggaattcaccctgccggtcgcgagatatccccaggctgctgtgtcctccttccgccagctcgacctgaccgaacaccgtacaggcgagttgctcgtactggatcaccggcaataaacgagcactgcgaaacgagcgagcaagccccagcaagtggatggcttccagcacgctggttttgccactgccgttggcgccgtagaggagattgatgcggggagagggggagaaggtcaccgggtgcagattgcgcaccgcggtgaccgagacgcgactgagggacatctagcttctgctgagcatgattacaggcgcatcggcatgacaacgtaggccgagtcgtcgttgtcggattcctgcaccagcgcactgctgttggaatcggataggatcaggcgtacctgttcggtggtcatcacgcccaacacgtcgagcaggtagctcacgttgaagccgatctccagcgaaccgccgttgtattccacgccgacttcttcttccgcctcttcctgctccgggttgttcgcctggattttcagctgaccgttggccagttgcagacggataccgcggtacttctcgttggacagaatcgcggtacggctgaaggcctcccgcagcgcctgacggtcgcccagtaccagcttgtcaccgcccttaggcagcacacgctcgtagtccgggaacttgccgtcgaccagcttggaggtgaaggtgaactcgccggtggtagcacggatatggtgctgacccagcacgatgctgacgatgccatccggctcggtgagcaggcgggccagttccaggatacctttgcgtggcacgatcacctggtggcgatccggctgaccgatatcggcctgcatcgagcacatggccaggcggtgaccgtcggtggccacggcgcggatgatgccggcggaaacctccagcaacatgccgttgaggtaataacgcacgtcctgttgggccatggcgaagctggtgcgctcgatcaggcgacgcagcttgctctgctccagctggcaggtcagcgagcccgggccttcttccacggtcgggaagtcgttggccggcaacgtggacagggtaaagcggctacggccagccttgaccaccagcttctgctcgtcgaccttgatgtcgatcagcgcatcgttcggcaggctcttgcagatgtccatcagcttacgcgccgggacagtgatttcgcctggctccgccggctcttccaactgcacgcgaccgaccagctcgacttccaggtcggtaccggtcagcgacagttgctggccttcgacaaccaacagcacgttggaaagtaccggcaaggtctgacgacgttcgacgacgccggcgaccagttgcaggggtttcaacagggcttcgcgttgaatggtgaaatgcatggtctagtcccttgccttaataagctgcgctggagtcatcaagtggtcagagtacgcagcaggttcttgtagtcctcgcggatgtccgcgtcggattccttaagttcattgatcttgcggcatgcgtgcaagaccgtagtgtgatcgcggccgccgaacacatcgccgatttccggcaggctgtggttggtcagttccttggacaaggccatggctacttggcgcggacgcgcgacagaacgcgagcgacgcttggacagcagatcggagattttgatcttgtagtactcggcgacagtgcgctgaatgttatccacagagaccagcttgtcctgcagggccagcaagtctttcagcgattcgcgaatcagctcgatggtgatatcgcgccccatgaagtgcgagtgggcgatgacacgcttgagcgcaccctccagctcacgcacattggagcgaatccgctgggcaatgaagaacgccgcatcgtgaggcagttcgactttggcctggtcggctttcttcatcaggatcgcgacgcgggtttccagttccggtggctctaccgctaccgtcaggccccagccgaagcgcgatttcaggcgttcttccaggccttcgatttccttcggatagcggtcactggtgagaatcacctgttggccgccttcgagcagggcgttgaaggtgtggaaaaactcttcctgggaacgctccttacgggcgaagaactggatatcgtcgatcagcaacgcatccaccgaacggtagaagcgcttgaattcgttgatcgcgttgagttgcaacgccttgaccatgtccgccacgaagcgctcggaatgcaggtacacgaccttggcattcgggttcttctttaataggtggttacccacagcgtgcatcaagtgggtcttacccaaacctacgcccccataaaggaagagcgggttgtaaccatgcttggggttgtcggctacctgccaggccgcggcgcgggccagctggttggacttgccttccacaaagttttcgaaggtaaaggtgcggttcaggtaactggtgtgcttgagcgcaccttccacctgaacggtgcgctgttcggcgcgtactggagcctgctgcgagctggcccccgccatcgggtcgaagctgtcacgagagggttcttcgctgacttcggcggctttctgggtcgccggtttggtcggtgcggccggagccagcgcagcgactggggcggcagcggctgcctgctgaacctgagaggcaacagcggcggccagcggagcattgggtgccgcacgaggagcagaactgcgtttgctgcctattaataaggaaagcgccggcgccatgccattgccatgctcatccagcagctcgagcacgcggcccaggtacttttcgttgacccaatcgagaacaaaacgattcggtgcgtatacacgcaactcgtcgccttcggcttcgacctgtagcggacggatccaagtgttgaattgctgggcaggcagctcatcacgcagaagctccacgcactgctgccaaagttccactgacacggatatcccctaagttgaaagccggtgaggcaaaaacaagccgccattgtagcgaccagacgcacacttatccacatgtaggttgatcacagggcactatgaatcaacgctttatcccgaaaaaacacgaccaatggtatgtgcataagctctgtggataaccatgcctgagggcattgcacaactgggggcgaaaatcggtggataacccgcttgtggataactcacctttccacacacagcttttccgatagcgcagcacaggcagagcaccgtttctcgacagtgttgtcattctctgtacaccacggcctacaaggcctgaatgtagttatccacagatagaggcatccctagcctttataagctttacagaaaagctttaaataattcccttctttatttttatatctggttgaccgggttcttcagtcttcgatgtggacatacccagacaaaggaaaagctggttggaaattgacctagaggcttgctttctctagaatcgccgatctcttaaaacgggggccattccggcccgttgtggacgaaccaggtaacacgacaatgaaacgtactttccaaccaagcactatcaaacgcgctcgtacccacggtttccgtgctcgcatggctaccaagaacggtcgtgccgtcctgtcgcgtcgtcgcgccaaaggtcgtgcgcgtctggcagtttgatactccggcactggaggtgagtcaggacttcagtcgggaaaagcgtctgcttaccccccggcatttcaaggcagtctttgactcccctaccggcaaggttccggggaaaaatctcctgctccttgcgcgcaacaacgatctggatcatccccgtctggggctggttatcggaaaaaagagcgtcaagctctccgttgagcgcaatcgcctcaaacgtctgatgcgcgaatcgtttcgcctgcaccaggatgctctggtcggctgggacatcgttatcgtcgcgcgcaaaggtttgggcgatgtagaaaaccccgaattgattcagcatttcgacaagctctggaagcgtctggcccgtaacaagccggcaccagcagccaaacccgaaactgtaggggtagacagcccgaatgcgtaaactggcactcgttccgatccagttttatcgctatgccattagtcctctgatggccagtcactgtcgtttctaccccagctgttcctgctacgcgtatgaagccatcgaaaatcatggccttctgcgcggtggctggctgacctttcgtcgtttaggtcgctgtcatccgtggaatcccggtggttatgacccggttccacctatccctacctcccgttcttcttcgatggccgagtaatcatggatattaaacgcacgatcctgatcgtcgccctggcaatcgtgtcctacgtcatggttcttaagtggaaccaggattatggccaggctgccctgccgactcagaatgttgctgccaacactgccaccccggctctaccggatacgcctgttggtaacaatgcttccgccagtgccgatgtacccagcgcgaataccgataccagcacccctaccgaaactccggtagcggcaagcaaagacctcatccaggtaaaaacggatgtgctcgatctggctatcgatcctcaaggtggtgatatcgcccagctgaagctgccgctgtatccacgtcgtcaagaccatccggaaattccgttccagctgttcgataacggtggcgaacgtacttatctggcgcaaagcggcctgaccggtaccaacggtccggatgcccgtcctgctggacgcccggtttactcggccgagaaaaagacttatcaactggctgacggccagaatcagctgaatgtcgacctgaaattcagcgatgccggcgtcaactacatcaagcgtttcacctttacccgcggtctgtacgatctgaaagtcacctatctgatcgacaacaccagcgacaaggcctggactggcaatctgtttgcccagctcaaacgcgacgccagctccgatccttcttccagcaccgccaccggtaccgcgacttacctgggcgccgccctgtggacaagttccgagccgtacaaaaaagtgtcgatgaaagatatcgacaagggctcgctgaaagaaaccgtgcaaggtggctgggttgcctggctgcaacactacttcgtgaccgcctggatcccggcgaagaacgaaagcaacgtggtgcagacccgcaaggataaccaaggcaattacatcatcggtttcaccggcccggcgctgaccattgccccaggtgccaaggctgaaaccaccgccactctgtacgccggtccgaagagccaggccgtgctgaaagagttgtccccaggcctggaactgactgtcgactacggcattctgtggttcattgcccagccgatcttctggctgctgcaacatatccacagcattgtgggtaactggggttggtcgatcatcttcctgaccatgctgatcaaggggatcttcttcccactgtcggcggccagctacaaatccatggcgcgcatgcgtgcagtggcgccgaaactggcggctctgaaagagcaacatggcgacgatcggcagaaaatgtcgcaagccatgatggagctgtacaagaaagagaagatcaatccgctgggtggctgcttgccaatcctcgtgcagatgccggtgttcctgtccttgtactgggtactcctggaaagcgtggaaatgcgccaggcaccgttcatgctgtggattaccgacctctcgatcaaggatccgttcttcatcctgccgatcatcatgggcgccaccatgttcatccagcagcagctgaacccgactcctccggatccgatgcaggccaaggtgatgaaaatgatgccaatcatcttcaccttcttcttcctgtggttcccggcgggtctggtgctgtactgggttgtgaacaactgcctgtcgatcgcccaacagtggtacatcacacgtaagatcgaagcggctaccaagaaagcagctgcctgacctactctgtggataaccactcaaaacgccccctagtggggcgttttgctatctgtcacttttgtctgcctctttatgtctggagcgggttatgaatgtccctcgtgaaaccatcgcagccgtcgccaccgcccaggggcgtggtggtgtgggcatcgtgcgtatttccggaccgctggccagcgctgccgccaaggccatcagcggccgtgagctgaaaccgcgttacgcccattacgggccatttttcagcgatcgggacgaggtcctggatgaggggatcgccctgtatttcccggggccgaactcctttactggcgaagacgtgctggaacttcagggccacggcggcccgatcgtcctggatatgttgctgcagcgttgcctgcagctgggatgccgcctggcccggccgggggaattcagcgagcgcgcgttcctcaatgacaagctcgacctggcccaggccgaagccatcgccgacctgatcgaagccagttccgcacaggccgcgcgcaatgccttgcgctctttgcagggggcattctccaagcgtgtgcataacctgaccgagcaattgatcgcgctgcgcatctacgtcgaggcggccattgattttcccgaggaagaaatcgacttcctggccgatggccacgtcctacagatgctcgacggggtgcgcgacgagttatccatcgtggtccgcgaagccggccagggcgccttgctgcgtgatggcatgactgtggttatcgctggccgacccaacgctggcaagtccagcctgctcaatgctctcgccggacgcgaagcggcaattgtcaccgagatcgccggcaccacccgggatgtgctgcgtgaacatatccacatcgacggcatgccgttgcacgttgtggataccgcagggttgcgcgataccgaagaccaggtggaaaagatcggcgtggaacgtgccctcaaggccattagcgaggccgatcgtgtattactggtggtcgacgccacggccccggaagcgctggacccctttgccttgtggccggagttcctggaacagcggccggatccggcgaaagtcactttgattcgtaacaaggccgacctgaccaacgaagcgatcgccctggaggtcagcgacgatggccacgtgactatcagcctcagtgccaaggcaggcggcgagggcctggaactgctgcgtgagcacctcaaggcctgcatgggttacgaacagacttccgaaagcagcttcagtgcacgcaggcgtcacctggaagccttgcaccacgccagcgacgcgcttgaacatggccgtgcgcaattaaccctggccggtgccggcgagctgctggctgaagacctgcgccaggcccagcaatccctgggagaaattaccggcgctttcagctcggacgacctgctgggccggatcttctccagcttctgcatcggtaaataaccccatctcgctataggagcagccgttcgacggcttggttgctcgtgatgctcatgacggtgttccgccggcatcacgggcaaacccgctcctgcaatccctcgactcccatcatttccgagtttgtcgggcgcaattgggcgctccggcggatttcttgtggctgccgtttggtcggacgagcttttttctgtggattaaaccctgtgaataactgcccttaggctcagttgataacagggcgtcaaaactgaggaaaacccgctctgtggataagcatcactttaatccacaggcttacaccggttatccaagggcctcgttgctacctaaccacagacttttgaatctctgtacacattgaaaacaaagggctgtataaatctatccacagataggtcggtgcctaagaataaacataaaaacaaagatttaataaatttctttctttttaatttctattgtccgtgagtcatccacagctggttaaattttgtgcaaagggttctttaggaagggcgaagaccctatacttgtccgttatcccaagaacccatccttttttacccatataagcaggcacgaggtgcgtggtggatttcccttcccgttttgaagtgatcgtcatcggcggcggtcatgccggtaccgaggcagcacttgcatcagcacgcatgggggcaaaaaccctgttgctgacgcacaacgtggaaaccctcggagcaatgagctgcaatcccgcgattggcgggatcggtaaaagtcatctggtcaaagaaatcgacgccctcggcggcgcgatggccatggctaccgataaaggtggtattcagtttcgggtgttgaacagccgtaaaggcccagccgtgcgtgctacccgcgcccaggccgaccgtattctgtacaaggctgctgtccgcgaaatcctggaaaaccagccgaacctgtggatatttcaacaggcagcggatgacctgatcgtcgaacaggaccaggtccgcggcgtcgtgacccaaatgggcctgcgtttcttcgccgaatccgtggtgttgaccaccggtaccttcctcggcggacttatccacatcgggttgcagaattattccggcggccgtgccggtgatccgccgtcgatcgctctggctcgccgtctgcgcgaattgcctctgcgtgtcggccgcctgaaaaccggtacgccaccgcgcatcgacggccggtctgtggatttctcggtgatgaccgagcaaccgggcgatacgccgatcccggtcatgtccttcctgggcaacaaggaacagcatccgcggcaggtcagttgctggattactcataccaatgcgcggactcacgaaatcatcgctgcaaaccttgaccgttcgccgatgtattccgatgccggctcgatcgagggcattggcccgcgctactgcccgtcgatcgaagacaagatccatcgctttgccgacaaggaaagccatcaggtcttcatcgagccggaaggcctgaccactcacgagctgtacccgaacgggatatccacaagcctgccgttcgatgtgcagttgcagatcgtgcaatcgatccgcggcatggaaaacgcgcacatcgtgcgtcccggctatgccatcgagtacgactacttcgatccgcgcgacctgaagtacagcctggaaaccaaagtgatcggcggcctgttctttgccggccagatcaacggcaccaccggttacgaagaagccggcgcccagggtttgctcgccggtgccaacgccgcattgcgcgcgcagggcaaagacagctggtgcccgcgtcgcgatgaagcctatatcggtgtgttggtcgacgacctgattaccctgggaacccaggaaccgtatcggatgttcacatcccgtgccgaataccgcctgatcctgcgcgaagacaatgccgacctgcgcctgaccgaaaaaggtcgggaactgggtctggtggacgatgtccgttgggccgcgttctgcaaaaaacgcgaaggtatcgctctggaagagcaacgcctgaaaagcacttgggttcgtccgggtaccgagcagggtgatgcgatcgccgaaaagttcggcacaccgctgacccatgagtacaacttgctgaatctgctgagccgtccggaaatcgactacgctggtttggtcgaagtgaccgggcagggcgcagaagatccacaggtcgccgagcaggtcgagatcaagaccaagtacgccggttacatcgaccgccagcaggatgaaatcgctcgtctgcgggccagcgaagacaccaagctgcctgtggatatcgactacagcaacatttccggtctctcgaaagagatccagagcaagctcggcgccacgcgtcctgaaaccctgggccaggcctcacggattccgggcgtgacccctgcagcgatttcgctgttgatgattcacttgaaaaaacgcggcgcgggccgtcagttggagcaaagcgcttgagttcgcaggtcacctcgcaacatgcagaagagttatccacaggtgctcgccaactcggtgtcaacctgacagaagcccagcacgagttgctgctgggttatctggccctgctgatcaaatggaacaaggcttacaacctgaccgcagtacgcgatccggatgaaatggtctcgcgtcatctgctcgatagcctgagcgtgatgtcgttcatcgaaaacggccgctggctggacgttggcagcggcggcgggatgccgggcattccattggctatcctgtttccggattcgcaagtgacctgtctggacagcaatggcaagaaaacccgcttcctgacccaggtcaaactggaactgaagctggataacctgcaagttatccacagtcgtgtcgaagctttccagccgcagcagccattcaacgggatcatttcccgggcattcagcagcatggagaacttcaccaactggactcgccacctcggcgaccgcgatacacgttggctggcaatgaagggcgttcatcccgccgatgagctggtagcattgccggcggacttccacctcgatagcgaacacgccctggccgtacccggttgccaaggccaacgccatctgctgatactgcgcctcacggcatgattgggaacacaagcaagaatggctaaggtattcgcgatagcgaaccagaaaggtggtgtgggcaagaccaccacctgcatcaacctcgcagcatcgctggttgctaccaagcgccgggtgctgttgatcgatctcgatccacagggcaacgccaccatgggtagcggtgtggataaacatggcctggaaaattcggtctacgacctgctgatcggcgaatgcgatctggcccaggccatgcattactccgaacacggcggctatcaactgctgccggcgaaccgcgacctgaccgccgcagaagtggttctgctggaaatgcagatgaaggaaagccgtctgcgcagtgccctggcgccgatccgggaaaactacgattacattctgatcgactgcccgccgtcgctgtcgatgctcacgctcaacgccctggttgccgccgatggggtcattatccccatgcagtgcgagtacttcgctctcgaagggctgagcgaccttgtggataacatcaagcgcatctccgaattgctcaatccgaacctcaaggtcgaaggcttgctgcggaccatgtacgacccgcgtctgagcctgatgaacgatgtttctgcgcaactcaaggaacacttcggcgatcagttgtacgacacagtgatcccacgcaacatccgtctggcggaagcccccagttatggcatgccggcgttggtctacgacaaacagtcccgcggtgccatcgcctatctggcccttgctggcgagatggttcgtcggcaacggaaaaattcacgcgcagccgctgcccagccaacttaaggaatccccatggccgtcaagaaacgaggtctcggacgtggactggatgcactgttgagtggtccgactgtcagctcgctggaagaacaagcggttcaagccgatgtgcgtgagctgcaacatttgccgctggacctgatccagcgcggcaagtatcagccgcgccgggacatggaccctcaggcactggaagaattggcgagctcgatcaagactcagggcgtaatgcagccaatcgtggtgcgtccgatcggttccggccgttttgaaatcatcgccggcgagcgtcgctggcgcgccagccagcaggcgggtcaggaaaccattccggcgatggtccgcgatgtgcctgacgaaaccgccattgccatggcgctgatcgagaatatccagcgcgaagatctcaaccccatcgaggaagcggttgccctgcagcgcctgcagcaggaattccagctgactcagcagcaggttgccgaggctgtgggtaagtcccgcgtcaccgtagccaacttgctgcgcctgatcgctttgcctgaagtgatcaagaccatgctgtcccacggcgacctggaaatgggtcatgcccgtgccttgctgggtttgccggaaaatcaacaggttgaaggggcgcgacacgttgtcgcacgtggcctcaccgtacgccagaccgaagccctggttcgccagtggttgagtggcaaacagcagcctgccgaacctgtaaaacccgacccggatatcgcgcgcctggagcaacgcctggccgagcgcctaggctctgcggtgcagattcgtcacggaaagaaagggaaaggtcagttggtgatcgggtataactccctcgatgagcttcaaggcgtccttgcacacatccgctgaaacatttcctcatgtagcgtgcagtcggaaatcactacccggcagttgaataggggctgaaccgcccctatactctgcgcgcattttgtcggcacaaattatgccaagttattgaattctggcagccgacccatgaggagcaagagtgatggaaacccgcacgccaaaccgcctgccgttccatcgcttggcggttttcccggttttattggctcagttggtcgttttatggctggccgccctggcgctctggcattggcatggagtcgtagccggatactcaggcctttgtgggggactgatagccttgctccccaatgtgtatttcgctcatagggcatttcggttttccggcgcccgagcagctcaagccatcgtccggtctttttatgccggcgaggcgggcaaactgattttgacggcagtgctctttgcattgacgttcgcaggtgtgaagccattggcgccgctagcagtattcggcgtcttcgtgctgacccaactggtcagctggttcgctcccctgcttatgagaacaagactttcgagaccttagggcgtttgaggcaaccatggcagaaacaaccgcttcgggctatatccagcaccacttgcagaacctgaccttcggtcagctacctaatggcggctggggctttgcccacaccgcagcagaagccaaagaaatgggcttctgggcattccacgtcgatactctcggctggtctgtggcgttgggtctgatcttcgttcttcttttccgcatggcggccaagaaggcaacttccggtcagccaggtgctttgcagaacttcgttgaagtattggtccagttcgtcgatggcagcgtgaaagacagcttccatggccgtagcccagtgattgcaccgctggcactgaccatcttcgtctgggtgttcctgatgaacgccatcgacctgatcccggtcgactggattcctcaactggccatcctgatctccggcgattcgcacattcctttccgtgccgtatcgactaccgacccgaacgccacgctggccatggccttctcggtgtttgcactgatcattttctacagcatcaagatcaagggcatcggcggcttcatcggcgagctgaccctgcacccgttcggcagcaagaatatctttattcaggcgctgctgattccggtgaacttcctgcttgaattcgtgacgctgatcgccaagccaatctctctggcacttcgtctgttcggcaacatgtacgctggcgaactggtgttcatcctgatcgccgtgatgttcggcagcggcctgctctggctcagcggcctgggcgtggtgctgcaatgggcgtgggctgtgttccacatcctgatcatcaccctgcaagcgtttatcttcatgatgctgaccatcgtctacctgtcgatggcgcacgaagagaaccattaagaccggtctcgaccagtctgatgtccctcccggtcaaacgggagggggcccgtctagggcacgatgaaacgatttgttttaccgctttaatctaaaaaacctaaaccatacgacgtaaaagtcgggaggaaagatggaaactgtagttggtctaaccgctatcgctgttgcactgttgatcggcctgggcgcactgggtaccgcaattggtttcggcctgttgggcggcaagttcctggaaggcgctgcgcgtcagccagaaatggttccaatgctgcaagttaaaatgttcatcgttgccggcctgctcgacgccgtgaccatgatcggcgttggtatcgctctgttcttcaccttcgcgaaccccttcgttggtcaactcgctggctaatcactcgaattttcgagttgattggtgtgatggacaacgaacgagcgaggtgttggcgtgaacattaatgcaaccctgattggccagtccgttgcgttcttcatttttgtactgttttgcatgaagttcgtgtggcctccggtcatcgcggctttgcacgaacgtcagaagaagatcgcggatggactggacgctgccagccgagcagctcgcgacctggaactggcccaagagaaagcgggtcagcaactgcgcgaagcaaaagctcaggcagccgaaatcattgagcaagccaagaaacgcggtaaccagatcgtcgaagaggctgttgaaaaagcccgtgtcgacgctgaccgtgtgaaggttcaggctcaggccgagatcgagcaggaactgaacagtgtcaaagacgcgctgcgtgcccaactgggtgtgctggccgttggcggcgccgagaagatcctgggtgccacaatcgatcaaaacgcgcacgcggagctggttaacaaactggctgctgaaatttaagcgagggcgatcatggcagaactgaccacgttggcccgaccttacgctaaggcggccttcgagcacgctcaggcccaccagcagctggcctcttggtcagccatgctcggcctggctgcagcagtgtcgcaagacgacaccatgcggcgcgtgctcaaggccccgcgactgacgagcgcagacaaggccgccacgtttatcgacgtgtgcggcgacaagttcgatgccaaggcacagaatttcatccacgtcgttgccgaaaacgaccgtctcctgcttctgccggagatcgccgccctgttcgacctgtacaaggccgagcaagagaagtcggtagatgtggaagtcaccagtgcttttgcgttgaaccaagaacagcaagacaaactcgccaaggttctcagtgcacgactcgaccgggaagtgcgcctgcaagttgcggaggacgctgccctgattggtggtgtcgtcatccgcgccggcgacctggttatcgatggctcgattcgcggcaaaatcgcgaaacttgccgaagcattgaaatcttgagtttgaaggggcagcagagcaatgcagcaactcaatccttccgaaataagtgaaattatcaagggccgcatcgaaaagctcgatgtgacctcccaagcccgtaacgaaggcactgtcgtcagcgtttctgacggtatcgtgcggattcacggtctggccgacgtcatgtacggcgagatgatcgagtttccgggcggtgtctacggtatggcactcaacctcgagcaagactccgtaggtgccgttgtactgggcgcatacacgactctggctgaaggcatgagcgccaagtgcactggccgcatcctcgaagttccggttggtaaggaactgctgggtcgcgtagtcgacgcactgggtaacccagttgacggcaaaggtccgctgaacaacaccgagaccgacgcggtcgagaaagttgctccaggcgtgatctggcgtaagtcggtagaccagcctgtacagactggctacaaggctgtcgatgccatgatccctgtcggccgtggccagcgtgagctgatcatcggtgaccgtcagatcggtaagaccgctctggcgatcgacgcgatcatcaaccagaaagacagcggcatcttctgcgtatacgtggctatcggtcagaaacaatcgaccattgccaacgttgttcgcaagctggaagaaaacggcgctctggccaacaccatcatcgtggctgccagtgcttccgaatccgctgccctgcaattcctggcaccgtactccggttgcaccatgggcgaattcttccgcgaccgcggtgaagacgcgctgatcgtttatgacgatctgtccaagcaagcagtggcttaccgccagatttccctgctgctgcgccgtccaccaggccgtgaagcttacccaggcgacgtgttctatctccactcccgtctgctggagcgcgcatcccgcgtttcggaagagtacgtagagaagttcaccaacggcgcggtaactggcaagaccggttccctgaccgcactgccgatcatcgaaacccaggctggcgacgtttccgcgttcgttccgaccaacgtgatttccatcaccgacggtcagatcttcctggaatcggccatgttcaactccggcatccgcccggcagtgaacgccggtgtttcggtatcccgtgtaggtggtgccgctcagaccaagatcatcaagaagctgtccggtggtatccgtaccgccctggctcagtaccgtgaactggcggcattcgcccagttcgcttctgacctggacgaagcgacccgtaagcaacttgaacacggtcagcgcgttaccgagctgatgaagcagaagcaatacgcgcctatgtccatcgctgacatgtcgctgtcgctgtatgccgctgaacgtgggttcctgactgacgtcgaaatcgccaagatcggtagcttcgaacaagcgctgattgcttacttcaaccgcgatcacgccgatttgatggcgaagatcaacgtgaagggtgacttcaatgacgaaatcgacgctggcctgaaagccggtatcgagaagttcaaggccacccaaacctggtaagccgcagcgggggccgcgaggctcccgcttgctaacctgataggtgttacatggcaggcgcaaaagagattcgcagtaagattgcgagcatcaaaagcacgcaaaagattaccagcgccatggaaaaagtggcggtcagcaaaatgcgcaaggcacaaatgcgcatggctgctagccgtccttacgcggagcgcatccgccaggttattggtcatctggccaacgccaacccggaatatcgccacccgttcatgatcgaccgcgcaatcaagcgcgtcggttatatcgtggtgagcagtgaccgtggtctgtgcggtggtttgaataccaacctgttcaaggctttggtcaaggacatggcggtaaaccgcgaaaatggcgtcgagatcgatctgtgcgtggttggcagcaaaggtgcggctttcttccgtaacttcggcggtaacgtcgtcgctgcaatcagccacctgggcgaagagccgtcgatcaatgatctgatcggcagcgtcaaggtgatgctggatgcctacctggacggccggattgaccgcctgtccgtggtgtccaacaagttcatcaacaccatgacgcaacagcctacggtggagcagttgattccgctggtggcaaccccggatcaagaactcaagcaccactgggactatctctacgaaccggacgccaaagagctgcttgacggcttgatggttcgctacgtggagtcgcaggtctaccaggcggtggtcgagaacaacgcggctgaacaagctgcgcggatgatcgcgatgaagaacgctaccgacaacgccggtgatttgatcagcgatttgcagctgatctacaacaaggcgcgtcaggctgcgatcacccaagagatctcggaaatcgtcggcggcgctgccgcggtttaacggttcaaatattcagaggatccagctatgagtagcggacgtatcgttcaaatcatcggcgccgttatcgacgtggaatttccacgcgacagcgtaccgagcatctacgacgccttgaaggttcaaggcgccgaaaccactctggaagttcagcagcagctgggcgacggcgtggtacgtaccattgcgatgggctccaccgagggcttgaagcgcggtctggacgtcaacaacactggcgcagccatctccgtaccggtcggtaaagcgaccctgggccggatcatggacgtactgggcaacccgatcgacgaagctggtccgatcggcgaagaagagcgttggggcattcaccgtcctgcgccgtccttcgctgaacaagctggcggcaacgacctcctggaaaccggcatcaaggttatcgacctggtttgcccgttcgccaagggcggtaaagtcggtctgtttggtggtgccggtgtgggcaaaaccgtaaacatgatggaactgatccgtaacatcgccatcgagcacagcggttattccgtgttcgccggtgtgggtgagcgtactcgtgagggtaacgacttctaccacgagatgaaggattccaacgttctggacaaagtggcactggtatacggccagatgaacgagccgccgggaaaccgtctgcgcgtagctctgaccggcctgaccatggccgagaagttccgtgacgaaggtaacgacgttctgctgttcgtcgacaacatctatcgttacaccctggccggtaccgaagtatccgcactgctgggccgtatgccttccgcagtaggttaccagccgaccctggctgaagagatgggcgttctgcaagaacgtatcacttcgaccaagcaaggctcgatcacctcgatccaagcggtatacgtacctgcggacgacttgaccgacccgtcgccagcgaccaccttcgcccacttggacgccaccgtcgtactgtcccgtgacatcgcttccctgggtatctacccagcggtagatccactggactcgacttcccgtcagctggacccgaacgtgatcggcaacgagcactatgaaaccgctcgcggcgttcagtacgtgctgcagcgctacaaagagctgaaggacatcattgcgatcctgggtatggacgaactgtccgaagccgacaagcaactggtatcccgcgctcgtaagatccagcgcttcctgtcgcagccgttcttcgtggctgaagtcttcactggttctccaggcaaatacgtttccctgaaagataccatcgctggcttcaaaggcatcctcaacggtgactacgaccacctgccagaacaagcgttctacatggtcggcggcatcgaagaagcgatcgagaaagccaagaaactgtaatcccggcgcccggcaacgggcgctaatttaggttgaggcaagcagatggctatgacagtccattgcgatatcgtcagcgcggaaggggaaatcttctccggtctggtcgagatggtgatcgcacacggcgagctcggggatcttggtatcgccctgggtcacgctccgctgatcactaatctgaaaccaggtccgatccgcttgatcaagcagggcggggaagccgaggtgttctacatctccggtggtttcctcgaggttcagccgaacatggtcaaggttcttgccgacaccgtgcagcgtgctgccgacctggacgaagcctccgctcaggaagccgtcaaggctgctgagaaggccctgaatgaaaaaggcgcagatttcgactacggttctgctgctgcacgtctggccgaggccgcagcccagctgcgtaccgtccagcagatccgcaagaagttcggcggctaagccgcggaatttccgcgtgattgattaaaaagggtagcctcggctaccctttttctttttttgcaattcacctcatggtcgcaaccgctgaccccccaggattggtagccagtcatgtctctcgaaatcattattctcgctgccggtcaaggcactcgcatgcgttcgtcgttgccaaaggtgctgcacccggtggcgggcaactccatgctggggcatgttatccacagcgcccggcaactcgatccacagcgtatccatgtcgtcatcggtcacggtgccgatgcggtgcgtgagcgcctggcggcggacgacctgaatttcgtgctgcaggacaagcaactgggaaccggtcacgccaccgcccaggcggtgccgttcattaccgccgataccgtgttgattctctacggtgacgtgccgctgatcgaagtcgaaaccctgcagcgcttgctcaagcatgttgttcccgggcaaatgggattgctgaccgtggagctggacgacccgaccgggtatggccggatcgttcgcgatgccgacggcagggtagcagccattgtcgagcacaaggacgccagcgaagcgcaacgcgctatcaccgaaggcaacaccggcatccttgccgtgccggccaatcgccttgccgactggatgagtcgtctgtcgaataacaacgcccagggcgagtattacctgactgacgtgatcgagatggcggtcagcgatggtctgttggtggccaccgagcaaccgcatgatccaatggaagtgcagggcgccaacgatcgcaagcagctgtccgagctggagcgtcattaccagttgcgcgaaggtcggcgcctgatggctcagggcgtgaccttgcgcgacccggcacgtttcgatgtgcgcggtgaagtgacggtgggccgcgacgtgctgatcgacatcaacgtgattctcgaaggccgcgtggtcatcgaggacgacgtggtgatcggcccgaactgcgtgatcaaggacagcaccctgcgcaagggcgtggtgatcaaggccaacagccatatcgaaggtgcggtattgggtgaaggcagcgatgccggtccgttcgcccgcctgcgccagggcactgttctcgaagcccgtgcccatgtgggtaactttgtcgagttgaagaacgcacgcatgggcgagggcgccaaggccgggcacctggcctacctgggcgatgccgagatcggtgcgcgcagcaacatcggcgccggcaccattacctgcaactacgatggcgccaacaagcatcggacggtgctgggcgaagacgtcttcattggttccaacaactcgttggtggcacctgtggatatccaggatggcgcgaccacggcggccggttccaccatcaaccagactgtggaaaaagcccagctggccgtggcccgtgcccgacagaagaacatcgacggctggaaacgcccggtgaaaatcaagaagagctgagttatctacagccgatgcaaggtcggtgctgttcgctctgcctatcgtgagcaaactcgcggctacagggttgatacctatccttctgtggccgcgaagcgtcatccctgtggataattccttcaggctgttattcacagcatttttttcatttccctcgcttgacgaatttctggcaataggttttgattgcttccgttatctttcgaatcgaaacttaagtgctcatgtcgaaacgcaatacgccccagcgccgtcacaacattctggccttgctcaatgaacagggcgaggtgagcgtggatgagctggctaaacgcttcgaaacttcggaagttacgatccgcaaggacctggcggccctggagagcaacggtttgttgctgcggcgctacggcggcgcgatcaccatgccgcaggaactggtcggcgatctcggccagccagtctccccctataaacaagccatcgcccgcgcggcggttgcgcggattcgcgaacacgcccgcatcatcatcgacagtggcagtaccaccgcggccatgattcccgaactcggccagcagccgggcctggtggtcatgaccaactcgctgcatgtggccaatgccctgagcgaactggagcatgagccggtgctgttgatgaccggcggtacctgggaccctcactccgagtcgttccaggggcaggttgccgagcaggtattgcgttcctacgacttcgaccagctgtttatcggtgccgacggcatcgatctggtgcgcgggaccaccaccttcaacgagctgctcggcctgagccgggtgatggccgagatggcgcgggaagtcgtggtgatggtcgaggccgacaagatcggccgcaagattcccaacctggagctgccctggagcagcgtccatacccttattaccgatgatcgcctgcctgcagaggcccgcgaccagattcaggcccgcggcattacgctgatttgcgcggcagtcatctaggagagaaaccatgtgtggaattgttggcgccgttgctgaacggaatatcacgcccatcctgctcgaaggcctcaagcgtctcgaataccgcggctacgacagcgccggggtggcggtcctgaccaacgatggcaagctcgagcgcctgcgtcgtccgggcaaggtcagcgagctggaacaggccttggccggcgcgccgctggtcggtcgcctgggcatcgcccacacccgctgggccactcacggcgcgccgtgtgaacgcaatgcccacccgcatttctccggcggcctggcggtggtgcacaacggcatcatcgagaaccatgaagtcctgcgcgagcaactcaagggcctgggctacgtgttcacctcggacaccgacacggaagtcatcgctcatctgctggaccacaaactcaaggacctgggcgacctgaccgtggccctgaaagccaccgtcaaggaactgcatggcgcctatggcctggccgtgatcagcgccagccagccggaccgcctggttgccgcccgcagtggcagcccattggtgataggcctgggcctgggggaaaacttcctggcttccgaccaactggccctgcgtcaggtaaccgatcgcttcatgtacctggaagagggcgatatcgccgagattcgccgcgacagcgtgcagatctgggatgtcgacggcaaagcggtcgagcgtgaagccgtgcaataccgcgacggcgccgaggccgccgagaagggcgagttccgccacttcatgctcaaggaaatccacgagcagccagccgtggtgcaacgcaccctcgaaggccgcctgagccaggaccaggtgctggtccaggctttcggcccacaggccgccgagctgttcgccaaggtgcgcaacgtgcagatcgtcgcctgcggcaccagctaccacgccggcatggttgcccgttactggctggaagaactggccgggattccgtgccaggtcgaagtggccagcgagttccgctaccgcaaggtggtggtgcagccggataccctgttcgtgaccatttcccagtccggcgaaaccgccgacaccctggccgcgctgcggaatgccaaggagctgggtttcctcgccagcctggcgatctgcaacgtcggtatcagctcgctggtgcgtgagtccgacctgaccctgctgacccaggccggtcgcgaaatcggcgtggcatcgaccaaagcctttaccacccagctggttggcctgctgttgctgaccctgtccctgggtcaggtccgcggcactctgggcgaaggcgtcgaagccaccctggtggaagaactgcggcgcttgccgacccgcctgggcgaagccctggcgatggacagcacggtggaaaaaatcgccgagctgttcgccgagaagcaccacaccctgttcctcggtcgtggcgcacagttcccggtggcgatggaaggggcactcaagctcaaggaaatctcctacatccacgccgaagcctacccggccggcgagctcaagcacggtccgctggcccttgtggataacgacatgcccgtcgtcaccgtggcgccgaacaacgagttgctggagaagctcaagtccaacctgcaggaggtccgcgcccgtggcggcgagctgatcgtctttgccgacgagcaggccggcatgaccaacggcgagggcacgcatgttatccacatgccgcatatccacgacatcctgtcgccgatcctctacaccatcccgctgcagctgctgtcttattacgtggcggtgctcaagggcactgacgtcgaccagccgcgcaacctggccaagtcggtgacggtggagtgagttatccacagccgggctgatttttcggcccggtcggcgctttgacaacgggcctatatggcccgttgccttatgtccggattattcaaaacaatatgatgaaacgatatagcaactgatttgcgctcctaaaaaggctgatctatacctccaagccacacattgatgaggtgtgtgcaaagcaagggctcacggaaccggagctcctgcataacaagggatagaaacagcgcttcaaggatgattcagccatgcatgcgtatcggcatttcggtcgttgttccgtttttaaacgaagccacaattcttcgatccaggttttcggccaggtagctcattgccaccggcgctcgattcgacctgattcccctcctacctatcgccttcgcggcgctatcccttctgtccatcgcgcctctatggctcctcggcatcagccgagtgtcggcgtgtggcgagaaacatccgagtgttccacccgggtgaccctgggcaacagcccgaacggactctgtaaaggtgatccgttgttctgaggcaatcctgcctcgattgaagcgaatgtcggaccggatcggctcaccccgcaggtgacccgaggcggatcccgtgtagtcgttcgtccaacctttttatgacgcagtacccacttttccaggatggagatggttatgactgtactcagagttggcatcgtcggcctcggcgcgcagatgcaagaaaacctgctgcccacgcttctgcaaatgccggatattcgcatcgtcgcggtgtgcgacagcgacttgaaccgcgccggacagattcaccgtttcatctccgaggtcgcgatcaccgacgacttcgacgacatgctcgataccgctgcgctggatgcggtggtcatggcgtgcccgccccaggcgcaccgcgacctggcgatcaaggcaatggccaagggcgtgcatgtcttcgtcgagaagccgccgtgcttcaccctcgccgagctcgaatacctgatcggcgcggcgcgccaggcccaggtcgtcaccggcgtgggcatgaacttcaaatatgccaagcccatgcgccagctgcgcgatatgacgcgcaccgagcagttcggcaaggtcgtgcacatccagctcaaccactatgcgagcaaacccaccgcgccgctgtgggggctggattccacgctgcgttcgttcctgctggcccaggcgattcacaccatcgaccttggcgtgaccttcggcggcggcgaattgcgcgatatcgaatcccgggtccagcgccacgaagactcgctgctggtgagcctggagctcggtttcagctccggcgcgacggtcagcctgctgagcggaacgatgttcccgtacttcgagttcgacatgaagatcgtcagctccaattcgatgatggtcgagctcaacaacctgtggaacatcaccctgcacgagccggtgcatggcaccggggcaaccggcaccgccaagcgctggcgcggcgcgtggcagccagggcctttggattcgggttatgagcgcagcggctatttcggcgaactggagaagttcttcgacgcggtgcgcaaccgtacgccttacgaggccagcttcgagagcctgctgccgaccttccgggtgatcgagcagatctgtcatgccgacagcgcccgcgccgatgtcgcccccgtgcttgccctccactccacccatgccgccaagtccccagcctttctcggagcccagaccaatgtcctctaatctctccagcgccgcccgcatctccgtttccgacaaataccgcccggtgtacgccgacgatctgctgaccttgcagaacaccctggaacggccgctgtccggcaccagcgatgtggtgggcgaatacgaggccaagctggcagcctggttcgaggcgcggcatgcgatcgcggtctcctcgggtggcgcggccctgagcgtggcgatctacgccgccggcgtcggtcccggcgacgatgtgctgctgacgccgagctgcccgctgtgcaccatctatccgatcatcgccgcgggcgccaacccgatcttcgtcgacacccgccgtcacggtttcggcgccgacccggaatcgatcaaggcccgcattaccccgcggacccgggcgatcatcgatattccgatgtggggctaccccaccgaagtcgatgagctgcaaggcctgacccgcgagctggggatcaagctgatcctcgacctggcgcattcccatggcagcaccctcaatggccggccgctgtcggcctacggcgacctgtcgtgcttcagcacccacgaacgcaagccgctggccactggcgagggcgggttcatcctcaccgacgacgaccaactggcccagcgttgccgcgactacagccgcttcggcaacctcaacggcaaggacttcggcctcaactacaagctggccgcgctgcctgccgccctgggcgccaaccgcctggactcgctggccgcgcagatcgagcagcgtcgcgccaatgccacctacttcctgcagcagctcgaccacagcaaggtgcgggaaaaggtcatcatcgagggcgggcggaccaactactacttcctcaacctggagctgcatttcgccgacaaccgggccttcatcgattacctggacgaggcgggcatcccgtcggacatcaagcgctacggctgcaaggcgctctatgagttcccggcgttggcccagtaccgcaacgactgccccaacgccgaggcgctgctggccagcatgaccaccatcccggtccatccggacatcacccgcgccgaactggattacatggccgaacggatcaaccagtacggggccgcatgatgacggacgttcctgatcgttcgaccctggaccggcatttcacggcctcggcgttcgtgttgaaccccgaccgcaagatgctcctgctgcaccaccgcaaactgggggtctggctgtatccgggcggccatatcgagcagggggaaacccctgatgtggcggtgctgcgcgagatctacgaagaaaccgggattcacgccgccctgctgggcgagcgtgacctggaactggccgatgccgagaccgatgtcactgtgttgcaccagccttaccggatcctctgcgaatacatcgatgacaagcgcgggccgcattaccacctggacctgatctacctcaccgccaccgacctgcgggcttgcccgccggagcgcgaggtggaaaacgcgcgcttcttcagccggcaggaaaccgccgagctgaagatgttccccaacttccggcgcatggtggaccgggtgttcgccgatgccgaggtatgggacatggtcggccggaaggtggcgccatgaaccaggcccttgctcaacaggcccgggtcatcgcggacaagtgcggccacgatacccccgacgatgtgcccgaactgcaacgagccctggcgacagggctgaccggcacctcgcagatcgtcgaggactacgagaccgcgctcgccgtgttgtacggcgtgcgtcatgtgatcgccgtgtcgtcgggggccgcttcggtcaccgcggcactggccggcgtgcggttccagccgggggacgaagtgatagtcgcgcccacgtgcccgatctgcaccgtcctgccgatcctgtccctgggcctggtcccggtgttctgcgatgtggcgccggacaacttcgggctcgacccggatgacctgcaacgctgcatcggcccgcgcacctgcgcggtgatcgaggtgccgatgtgggggtacccggttgcctcgcataccacctgggccaccacgcgccaggccggcatcccgctgatccaggacctggcccatgcgcacctgacgcgcctgaacggcagctggctggcgcagcatggcgacatcagttgcttcagcacccacgactgcaagttcatgtccaccggcgagggcggttttgtcatgaccgatgacgacgagcgcgccagccgtatccgcgcctacacccggttcggcaaccttaccggcgaaaccctgggcatcaacctcaagctcggcggcctgcaggccgccctcgggctggcgcgttcgcggcagttggaaagccgcttgcaccagcgccaggccaaccgccggcagctgctggagcaactggacaacccggcgctccgcgaactgccgctgacccccggtggagaggccaatgcctatgccttgttgttgcaggcggtggggcacgacgggcgtgaactggtgcactaccagcagcgtcacggcatcccttcggacatcggcaagtacgacaaccagccgctgtaccagctgccgctgctggcgcagtaccgccgcgattgccccaacgccgcccggttgctgcgttcgctgaccacggtgccgctgcatccgggcctggcgggcgacgacctggcttacattgcaaaggtgctcaatgactactccccagcctgataccgccacgggcggtcgacatgccgtggtcatcggcggcagcgtgacgggctgcctgacggccgcggtcctggcccggcgtttccagcgggtcacggtgatcgagaagagcgatttcttcgacgagaccggcccgcgccagagcctgccccaggagcaccacgtccacctgttgctgctgcgcggcaagcagatcatcgaaggcatcttccccggcaccctgagtgccctggagcagggcggcgcgcaagtggccgacctgggtcacgacgtgaagtggtaccagggcgggcgttggaaaaaccgctaccgcagtggcatttatgcccattattgcagccggcgcctgatcgacaaccagctgcgccgggccctgctcggcgtgctgaacgtcgaggtgctgtcgagcacccgggtcacgcagatcgagttcaccggggtcgatccttcccggcgggtcgaggcggtgaccgtcgacgatggccacggcgagcggacgctgcgctgcgacctgctggtcgacgccagcgggcgtggcacgcgcttgccgacgtggctgaaagaggccggctttggcgaggtcgagaccagcgtggtcaagaccgagctgggttatgcgtcgcgcatctaccggcgtcttccggcctatgccgagcagtggcaggtcctgctggtgctgcccaaggcgccgctgcagcgttccatgggagtgatcagcccgatcgaaggcgaccgctggatggtcaccactggtggctggttcggtcactttcccggcaacgatccgcaggagttcctgcaggcgctggcggcgcttccggtgccggatatccatgaggtgatccgcgacgccgagccgctgtcgccggtttacaccttcaagatgcccggcagtcgccgcacgcacttcgatcgggtcgagcactggccggccgggctgctggtggtcggcgatgccctgagcagcatgaacccgctgtacagccagggcatgaccatcggcgcgctggaggccgattgcatcgaccgccacatcgaccaggtattgcagggcgcccagggctttcgccaattgcagggacgcctgtgcgaagtggtcgatggcgcctggagcatggccaccaccgaagacttccgctttcccgaaaccgttggccagcgcagttggcgcacgcgtttccatcattggtacggcgccggcctgggccaggtctcggcgaacaatcggcgggccctggaaacccagattggcgtgaccaacctggtgatggagccgagcaagctctacacaccggcgatcgcctcgcgcatcgccctcaacgcccttcttgcggagaaaacccgaccatgatcgatgatcgactgcacttctcggggatcgaacacctggtcttcgactggaacggcaccctgatcgacgacatcgccctggcggtcagcgcggtcaatcgctgtggcgagcgctatgcggtgccgcccatcgatgccgcgcgctaccgtgcgctgttcgactttccgattgccgatttctacgcctccctggggttcgacctgcagcgcacgcccttcgcgcgaatcgtcgagcactacctggagcatttcgatacgcatgtcgcgcagtgcccgctgcacgatggggtattcgaggtgctggaggcagcgcgcaatgccggtatcggcgtctccatcgtgtccgcctcgcattgcgacgtgctgtgcaagaccctggaagccaagggcctgctcgggcatttcgagcatgtcgtggggctgagccacaaccaggccaccagcaagaccgccgaggccctgatgctgcaggaaaagctcggcacaccggccgggcgcaccctgttcatcggcgacaccctgcacgactacgacgtggcgcgggccgtcggctggcagccgctgctggtcagcaccggccatcaggacatcgaccgcctgcggcaggccgacgccccggtcttcagcggcttgggcgaactgctgggccattacgccagtggcgagcggcgcgccgtcgttcacgagggggcctgatcatggacaccgagcacatggtcctgctgggcctgatcgctgtttcgctgttgttgcgcgcgctggtggcgttttattaccgggatgcgcagcgggtgctgcgcctgctcaagctgataccgcgcctggaggggcggcgggagcagtactaccgcccgctggatacctggttcgcgccgctgccctttgtctggacgtggctggatatagtcgccgcggtgcaggcggcgtcgatctactcgtcgccgctggcctggctggcggtgctgctgtggagcggcgggcgcatgcgcgcgttgcaggagttcgggcacaacgcggtgcacttcgccctgtgtcgccaccatgcctggcagtggtggctgagcaacgtgttctaccagttcccgatgttcaagcgcgacatgcgcagccggcaccagacccacaccctggaacaccatcgccaccccaaccatccgcaactcgaccccaaccgcgcccgggtgcatgccggcggctacgtggcgggcctgtcgcccagtggtttctatgcgctgttgctgtacccgctgacccctcgcggggcctgggtcaatctcaccaccctggtgcgcagcagcctgctcaaccattcccgcctgatcaccctggtgcggtgcctgagcgtggcggcggtggcggcgttgctgtacgccttcggcggctggaaaggcgtgttgttcggctggttgctgccgttgctgacgtcctatccggtttttgcctggatctcgctgctgaccgagcaccgctggttcatcgaaggcaccgcgcgcaatcgccgcgagctggaatacctggcgggccggcccaccgattacttcggggtttccggctggctggtgcgggtattcatcgccccgacgtccgacgcctatcacctggcgcactccctgtaccccggcgtgcgctggaactacctgccggcgatcgaccggcacctgaaaatccacgaaccgcgctacagcagcaacgccagcgaagggttgctgttgcctcgcggcaatgcgcccacggccctgtccgaactctatgagcgcctggtgtgcaccgaacacgaaccgtcccccctgaagtcgagaggtagcctgtgacccattccactccaacccagcacgttcaacgtatcggcatcatcggcggcagcggcctgcaacagctgcctggcctgcaggacattcagcaagtggaatgcacgactgccttcggcacgccgtcgtcgccgctcaccctaggcacgctcaatggcgtgcccgtggcctttgtgcaacggcatggcgtggggcacgtgattccgccggcctcgatcaatgcccgggccaacatcgccgcgctgcgcagtgtcggttgcacgcaattgctgtcggtcagcgcggtgggcagcctgatccacgacgcgcctcccggcagctttgtgctgatcgaccagtacatcgaccgcaccatccagcgggaaaaaacctttttcggccccgggctggtcggccatgtgcccttcggcgagccggtctgcgcgcgcatgcgcggcgtgctcgccgagagtgccgaggccagcgatatccaggcgcgcaacggaggcacctacgtggtcatggaaggcccgcagttctccacccgcgccgagtcccacctgtaccgccaatggggcggcacggtgatcggcatgaccgcgatgcccgaagccaagctggcccgcgaggccgagctttgctacgcgatgatcgcgattccgaccgatttcgactgctggcacgaatcccacgagccggtgaacgccacgctggtggcgcaacgcatggcggacaccttcaacctgacccggcgcctggtgaccgaagccgtgacccgcctgggccagcatgccggtgcctgcccctgcggttgcgaccgcgccctggacaccgcggtgatgaccgcgcccgagcaccgcgacccgcgcatggtcgagcgtctgttgagcgttgcgccccatgccactcatctctctgcaagcaaggaataaagcgatgaaccaggccatctccaccaaggaccgggtgcggatccatcaggtcgaagtgctttcggacaattggtatgtgctgcgcaagaccacctacgacttccagggccgcgacggtgtctggcgcaccctggaccgggaaacctacgaccgcggcaatggcgccaccatcctgctgtacagcagggccaagcagacggtggtgctgacccggcagttccgtttcccggccttcgtcaacgaacacgacggcatgttgatcgaaacctgcgccgggctgctggacaaggacgatgcgcggacctgcatccacaaggagacggaggaggaaaccggctatcgcatccgtgaggtgcgcaaggtgttcgaagccttcatgagcccggggtcggtcaccgagcgcctgcatttcttcgtcggcgaatatttcgatgaagacaagcaaagcgagggcggcggcctggaacacgagggcgaagagatcgaagtgctggagctgccgatcgaccgggccctggcaatgatcgacagcggcgagatctgcgacggcaagaccatcatgctgctgcagtacgccaagctgcatcggctgctggaggccaccgatgactgaactcaacgccatcagctcgatggaaaacgccgagctggccgaattcatcgtcggcatcagccagcacatcggcatgccggtgcgcctgacccgttgttccacctcggagctgatcgagcgcctgcacggtggcagcgccggggcctgggacctgttgctgggcacggcggccaccgccttgctcgacccggccctggcctggcaactgatgccgctgacggacatcgagttctccggcctgccggaggcggcggtggccccggatcgccgctggttcgcggcatcgggtttcgtcccggccttctgttacgaccccaaggtcctggcccgcgaaggcctcgcggtgccgacccgctggcaggacctgacaggccccgaatgggccgggcgcatcgccttgcccgaccccgcgcgctccggtgccggttacctacacctcagcgcgctgctcgagcattacggcgaacccgcctgggcactgctggcccaggtggccgggcacggccctgcgatcagcggttcctccacggcgccgatcgaggccgtcgtgcaggggcaggcctggctgggggtgacagtgtcgaccgcggccacccgcgccgccgaacagcacccgcagctgcgctggtgcgtgcccgaagatgcacgctgttatgaggacgaggtgttcgcctgccgggccggctcgcccaacgccgcctatgcgcagcaggcgttgcaatggatgctcaccccggccgcggcgcagatcagccagcgttatggcaaggtcgtgccggaccaggctcacccggtcggcgcgctgcaaccgctgccggccttgcaggccagtcgcgacaaggccgcgcgctgtcggcaatggcaggcactgttcagccgggagacggcccatggctgaagccgcgcgggattccagtcaaacgctcagccgccaggagcaggtccgcgaggcgcgcccgtggttcctgtacctgctgttcgggctgttcggcgcccagcaagggttgctcgggccgatcatgccgttcctgcgcgacaccctggcgctcgacctcggttgggccggcctgcatttcgccgcttacgccgccggcctggcgctggtcggctggccctatcgctggctggaacgacggctgcgctcgacgagcatgagcaccatcgcctgcttctcggtggttattgccagcagcctgttcgcccttgccggacactggtcgctgagcttgctcgccgccgcggcgatgggcctgtcgggcggatttgtactggcggtagggcaggcggccctgggcgagcgttatcgcgaacaggccgtgccgaggctggtggaggcgcacatcgtcgccggattgtgcgtgctcggcggcgccctgctggtgggtggcatgaccggcctgggcctgtcctggcgcctggtgccaagcagcatcgccgctatcgcactgctggtgaccttgctctcgctgagtacctggaacgccccggcgacactcgccgccaccgatcaagcccgcgagagcgggcagaccctcatgacccggcgggtgcaactgagcctgtgggccttggtgctgctgggtatttctgcggaatggggcgtcggtttctggggcgcggaatacctggccgtgcatgtccaggtcagcgcctcggccgcggccacgctgatgagcctgtattttgccggcacggtgtgcgggcgcctggccagccgttatgcgttgatccgcatcagcccgttgccgctgctggtcggcgtgatactcggggccatcgccaccctggtgctgctgtacttcagccagacccggctgccgacagccttgttcatctttgtcctgggtgcctgcctgggcaatttcttcccgctgatcctcggttcggcgatgcgcatcgtgccccaggccagctcggccatcagcgcccaggcctcgcaggcggtgggcgtggcgctgttgctggcgcctttcctgctgggcttgctgtcctcgcggatcggtgtcgaagcggctttcagcctgttgatcgtctacccctttctcatgctgccgatcgcccgcggtctgcatttttccggagcacgcccttgaagctttctgccctgttgttcgatctcgatggcaccctcatcgacaccgatgacctgcacctcaacgcctacaaccagttgctgtcgcgctggggaaaatccatgagcctggattactacaaggcccacgtgatgggctttcccgacgacatgattttctccggcctgtttccccaggcgccggcggcgcagtacccggagctggcggcgcagaaggaggccatgttccgcgcccagttgcgcgagaccattccggtgcctggcgtgctgcgtaccctggattatgcccaggcggccggtatccccatggcggtggtgaccaacgcgccccgggaaaacgccgaagccatgctccagggcctggggattgccgagcgcttcgatgcgctggtgatcggcggtgagctggcgcgcggcaagcctgatccgctgccttacctgacggccttgcgcttgctggacgcgagcgccgatcaggcgctggccttcgaggactcgctggccggcgtgcgttccgcggcggcggcgggcatccacacctttggcatgctctcgggcctggaggaaactcagcttcgcgaggcgggtgcgcggagtatcatccgggacttcaacgatgaggccttgtggcagcgactccaggtccctgcctgagcccgggcggtccatgcgggacggtgccggggcagggcgccgtactgcgaggaccgtcatggaccgattccaggaaatgcaggtgttcatcagcgtcgcccaggagcagggcttcgcggccgcggcccggcgcctggggctgtccgcgcccagtgtgacccgggcggtggcggcgctggagcaacgtatcggcacccagctgctgacccgcaccacgcgcaatgtgctgctgacggaagccggccagcgttacctggaagacagccggcgtatcctcgccgagttgcaggacgccgagtcctcggccgccggcatccatgccctcccgcgcggacaactgacgatcaccgctccggtgctgttcggcgagctgttcgtgaccccgttgatggtggattacctggaacgctttcccgaagtcagcatcaatgccctgctggtcgatcgggtggtgagcatggtcgaggagggcatggacgtcgcggtgcgcatcggcgagttgcccgacagcggccagcacgcgatgcgtgtcggcgaggtgcggcgggtcatctgtgcttccccggcttttctggcgcggcatgggcggccgcggcatccccaggaactgcgccaggcgccggtgattgcgccgtcgtccatcggccagtccagaagctggctgttcgacgataacggaacacccttgaatattcgtccggagccgcggctggtggttaccgccaaccaggcggcgatcagtgccgcgtgcctggggctgggcctgacccgggtgctgtcgtatcaggtcgcgagcaaggtggcggcgggcgagctggagattatcctggcggagttcgaactggcgccgctgccgatccatgtggtgtatcagggcgggcgcaaggccccggcgcgggtgcgcagcttcgtcgacttcgcagtgcaggcgctgcgcgaacatccggcgttgcagtcgtagcgcggatcattgcgctgactgaaatgatggattgtgttttctggtgattccgttgttttggcccgagagagaagatggcgtccgtcagtgccgctcttgtgagccgcacccctgccagcggagtctgcccatgcaccccatcaagctctacaacttcccccgttccggtcatgcccatcgcgtcgaactgatgttgtcgctgctggggttgcctttcgagctggtcttcgtcgacctggcgaaaggcgagcacaagcaggcggacttcctggcgctgaacgcctttggccaggtgccggtgatcgacgaccagggcgtcgtgctggccgactccaacgcgatcctggtgtatctggcgcagaagtacggccagggccgttggctgcccagcgatccggttggcgcggcacgggtccagcgctggctgtcggtggcggcgggaccgattgcgttcggcccggcggtggcacggctgatcaccgtattcggcgcccagcgcaacgccgaggaggccatcgaccgctcccatgcgttgctcaaggtggtcgagcaggaattgacggccagcccttacctggcgggcagcgaaccgaccatcgccgacatcgccggctacagctacatcgcccacgcccccgagggcaatgtgtcgctggcggattatccacaggtccgcgcctggctggcgcgcatcgaagccttgcctggcttcgtcggcatgccgcgtaccgcggtgggcctgcaaagcgcctgaatctggcggcccggcaccctccgggcccgctgactgttgcgtcatcgacgcaggggagacccatcatgaacatcgaatccccctggcatgcaggcgaaacccgcctgcaagcccaggctggcgttgccgagcgcatggacgtcgtcgggcgcaaggtgatccgcagcgagatgcccgaccagcaccggcagttttatcaacagctgccgttcatgctgctcggggctgtggataaccagggcaacccctgggccagcgtgctcgaaggggctatcggtttcgcccactcgccaacccccgggcggctaaggctcgacagtctgcccgccgccgaagatcccgcccagctgacgccgggcgcggccatcggcctgttgggcatcgagctgcatacccggcggcgcaaccgcctcaacggtcggatcgtcgagctggacggcagcggttttgccctggaggtcgagcagtccttcggcaattgcccgcgctacatccagctgcgtcagttcgagtcggtgccgctggccgcgcaccggccggtgcagcgcctggatgcgctggatgaagcggcgagggcgatgatccgggacgccgatacgtttttcgtcgccagttacgtggagctcgagggacggctctgggtcgatgtgtcccaccgcggcggcccggccggtttcgtgcgggtcgagggcaaccgcctgagcattccggatttcgccggcaacctgcacttcaacaccctgggcaacctgctgctcaacccccgcgccggcctgctgttcatcgacttcagccgtggcgacctgctgcagctcagcggccgcactgaagtcgtgctcgacgacccgcagatcgccaccttcccgggcgccgagcgcctgtggcgcttcgaggtcgagcaactggtgcgccggcccgcggcgctggccctacgctggacggatcaggcgtaggacaaggctttttcctccagcaactcctggtacagctcgctccacctttggcccatctggtcggcggtgaacagctgccggtaacgggcttcggccttgagacccatctgcgcggcctgttccgggttgtcccagagctggcgcatggcggcgcggaaggccaggggatcgctgggcggcaccaccaggccggtttcgccatggatattgatgtagctggtgccggtgccgatctcgctggagatcatcggtttgccgtacatcgcgccttcgagcagcgagatgccgaacgcctcggagcgcaggtgcgaggggaagacgatggcgtagctcagttgcagcaaggccaccttgtcttcatcccccaggcggccgaggaaatgcaggttgcgcaggcccagtgccgcggcctgggcatgcagttcggcctccagcgggccggcgccgacgatcaccaccgggtagtccacgtccttgagggcatcgagcaggatgtgcaggcccttgtagtaacgcatcaccccgacgaacaggaaaaaacgctcgcccaggcgctggcgccactgggccatgcgttcggcgtcaggctgtggataaccagccttgttcaggccgtaggggatgacccgggtcttgtccgggaactgttgcagcacatcgctggtgtgcaggtagttcggcgacgcggcgacgatacggtcgacgctgtgcaggaagcggttcatcaatggccggtacagcttgagcaggtggcgctggcggatgatgtcggagtggtaggtggccacacagggcttgttcatgccactcatgaaatgcaccaggtccatgaacggccaggggaagtggtaattgaccacgtcggcttcggcggccatttcgcgaaactgcttgaacacgctgtaggagaaaccggtggaggcgaactggaaatccagctttgcctggtgcacctcatgctggcccaccttcagtgtgccggaggagggagtggggctcagcgtcaggacctggccgtcgatgccatagtgggcaccgctttcgcagagctggaagatgacctgctcagtgccgccgaccgagtcaggcaggtatgttttgtagaagtgtaagacccgcattcagcctcccatggcctgacggtaggcacgcgcggtgatccgcgcgcagcgcccccaggaaaaaagtcttgcctgttccaatcccgcttcgcggcacgcctgccaatggcggtcgtcttcgatcaggcgcagcaggtcgtggcgcaagccgtccacatcgtcggggtcgacatagttgccggccgcacccgcgacttccggcatcgccgaacatcgcgtcagtaccaccggcgtaccactggccatggcttccaggaccggaagaccaaagccctcgtatcgcgaaggaaaaaccagggccctggccccggcgaccagctgtgccagctgttcgtccggcaggtagcccagcagacgcacatggctgctggccagggcgctgtacagcgtttcgctgaattgcccctgttcccagcccgccatgccgacgatcagcaagggataacgctggcgcagggtttccggcagccgggcatgcgccagcaaagccagggacaggttcttgcgcggttccagggtgcccacgcagagcagatagccgtgggcttgcagcttgtaggtcgcgaggcagggctccagctcggccggctcccggggatgaaagcgtggagccgcacccagcggggccacgacaaaacgctcgcgtggcaggccgaagtaggcctgggcttcatcggcgacgaactgcgaatcggtcaggatcacccgcgcctgctccatgccggcgcccaggcgtcgctcgatttccttcagccgcgccggtggctgggtggccgggtaatgcacgtgggtcaggtcgtgcagggtcatcacagtcggcccctcgaacgacatcggccacagactgggttcgtggtagagatcgatggtggcgtgccggccctggtcgaagcgccgctgttccagccagcgccgcgcctggtaggccccgggaacctggcgcagccaggggctgagccgggagtaaccgggcatcgcggcagtcggcagttcattgctccaaccccagccatggaacagcgccagttcaaggcccggctcgccggccagggccggcgccagttccgcgacgtagtggccgatgccggtgcgtggcgcctggagaatgcgcgcgttaagggctacacgcatcgttcatctccaggaccgcaggggcgttccggtgctggcggacaatacgttcgatcaactggttgctggcgtcgcgccaagtcagccaacgccactcatccacatcacgggcagcagggaacacccccgtgcgctcttgctggatgaccagctcggccaggctctgcggatcgttcaggtcgaaataggccatgaactcgccgccgatttcgcgaaataccgggatgtcgctgcccatggcgggcaggccacgctgcatggcttccaccaggggcaggccgaacccttcgacataggaggggaacaccagcgccgtcgccttggaataggcgtactccaggctgttgtcgtccagtgaattgaacatgaacaggcgccggttcaactccgggtgccggcgaatccgttcgatcagcgcctcgcacttccagccgatgcgcccggcgatgcacaggcgggcctgggacccgctggcccagacacgctcgaaggcgtcgagcaggaacccgtggttcttgcgtggttctatggtgctgaccatcagaaacaccgctgcctggcccttgaacagctgggccagatccgggttgatccgagcgttttcgctgcactggtccagttccgagcccaggtggaaatagtcgaaccagcgctgtgccacctgctggcgcccgacccggcggagcatctcttcgcgaacctgatcgcggatggtcgcggaaatggcgatgtagccgtcggcggtgcgggctatccagtcgaaccaatggttgaacacccggaccagcccggcgtcgcagaactgcggatgagtcagggggatcagatcgtagatcaccgaaactattcccacgccgtcgcgcttgagctgttcggccaaggggaaaaagtcggcgtgccacgacgagtccaacagcaccagttgatcgcccggttgatgttgcagcggcacacaacgctgggggatttcatccacgttcaccaagcggttgcacaggcgcagggggatgctgagaaaggcaaaggccgtcaggcggcacgcgatgtagagcaagcgccgggcgatgtatgaatcggcaaagggtttgcggcgttccagagtccggtggcgcagccagaaaacgttagcgatctgctccaggcgtacccgcaggctcatcaggtcccagcgccgggtcggcagtggcttgaggctcagaacccgatacagcttgccgccgagcatcgccaccggaatgcattccaccgcgccgctggctgcgggcaactcgcggatgacgttgcgcaccacgcgctggatgcctgagttggtttcggggtgttcgaatacgtaggtgcattcgatcaacaggcggctcatggttccacctgctggctgattggctggacgggctccacgaagcccgggagggtgcgctcgatactggtccgcgcctgcaaccaggaacaaccgacgaagtcttcctggcggttattgatgacgtggaagaccaggccgtagtcgcgccattcgaagttgcgatccaggtgcgaatccagccgcgacaggctcagggccaccgagtagttgcccttgcccaggcccatggtgaaggcgaagcggaaggtgaccttctcgccggcgctcaagtcggtcagggcctggtccaggcgatgggtgttgatgccatacatgggctggccgagacggtccttgatcatgaagcccagcaccagccgttcgatgtcctggcgcacctcgacctgtacttccagcaccaccggctggccgacttcggccatctcgatcgagcgctcgcgttcgtcgcgcaggtgcacgctgaggatcgcggcttcgccggtgccggaaatggtccgtacctggccgttggcgagcatttcctggcgcaccgtctggccttcgcgttcggcgagcatggcgttgtagtagtccatcacctcttccggcttgccgtgcatggccacgcggccctgctcgagcaggatcgcggtgtcgcagatcgactggatcgccgagcggtcgtgggacacgatcagcagggtggtgccggcgcggcggaagctgcggatgcgctcgaaactcttgtgctggaagtaggcgtcgcccaccgacagcgcctcgtcgacgatcaggatgtccgggcgccgggccgtggccacgctgaatgccaggcgcatctgcatgccgctcgaataagtgcgtaccgggtgatcgatggcctcgccgatttcggcgaaggcttcgatttccgccatcagggcttcaatttcctcgacctgcatgcccagcagctgtccggccatgaccgcgttctggcgccctgtgaagtccgggtgaaagcccatgcccagctccagcaatgccgccacccgaccccgcagatggatctcgccgcaggtcggctgggtggtgccggtgatcattttcagcaaggtgcttttgccggcgccgttgaccccgactatgcccacggcctggcccggctcgatctcgaaatcgacgccctgcagcacccagtgcaggtgatggcgcggcctggaaaacggaatcatccattcgaacagccggctccagcggttcgggtactgcttataggccttgcccaggccgctgacgcgtatatgtcccatcagagctcatccaccatttcaccgacgcgctggcggaaaagccgcagccccatgccacagaacaacaggctgatcaccagcatcggggtcagcgaactccattgcggccactggtcgtacaggaacaggttctggtagctgtgcatcagcgcggtcagcgggttgagcgccagcaggcgctggatcgactcgggcaggatgctgatgggatagacaatgggggtcagccagaaccagaactgcaggaagatgccaaagaactgcccgacgtcgcgaaagaacacgttcagcaccccgaggatcatccccaggccggtgcagaacagcacctgcaacagcagcagcgggatcagcgcgagcagtgccaggcccggcaggcgcccggtgatcagcaggaagccgaggaacaggccgaggatgatcgcgaagttgatgccggcgttgagcagcacgatcaccggcaggcagatgcgcgggaagctgatcttcttcagcaggttggcgttttccaggaacatgctctggctgcgcagggtcagctcggaaaacaggccccaggtcagtagcccggcgcacaggtagacgctgtaggccaggccgtcctcgacccctggcaggcgggcgcgcatcacctgggaaaagatcaccgtgtagaccacgatcatcgacagcgggttgagcacggtccacaaggcgccgaacagcgagttgcgataacgcgcctggaactcgcgctgcacgctgccgaggatgaagccccggtagctgcgcagcgagcggtacagattgagcagcatcaggccgtcctgccgtattggtcttcgaaacggacgatgtcgtcctcgcccaggtattcgccgctctgcacttcgatgatgaccaagtcgatcacccccgggttcgccaagcggtgcttgtgtccggcggcgatgaaggtggattcgttgctgttgagcagatgcgagccttcgccgttgttggtgactctggccgcgccctggaccaccacccaatgctcactgcggtggtgatgcatctgcagcgacagcgtggcgcccggcttgaccacgattttcttgatcttgaaacctgggccttcctccagcacggtgtagctgccccagggccggttgaccgtgcgatgcaggcgataggcttcgtggttgcggtccttgagctgcctggccacctggcgtacgtcctgggcgcggtcggcgtgggccaccaggatagcgtcggcggtctcgaccacgatcaggttgtcgacgcctaccgtggcgatcatccggccttcgctctgcacgaagttgccgcggctgtcgatgaacagggcctcgccggtagcgcggttgtcctgggcatcggcgtcgaccagggcgctgatggcgcaccaggaaccgatatcgctccagtcgaagccggccgggatcaccgcgaccttgtccgagatttccatcagcgcgtagtcgatggaaatatccggcatatcggcgaaatgcgccgccgacaactcgtgctggacaatgcgtccggtttccaccggcgtgctggccgcctggcaggcgcggcccagctccagcagcgtgggagcgtgctgctgcaactcggccagcagggtcgcgaccgtgaagcagaacatccccgagttccacaggaaccggccgctgtcgaggtaaccctgggcggtcagcgggtcaggtttctcgacgaagcggcgaacccgggcgccgccacgttcgtccaggctatcgccggattcgatgtagccaaaaccggtttccggcgcggtcggggtgatgccgaacgtcaccaggtaaccggctttggccagttgcacggcgtgggcgacagcattgcgaaaggccgcctcgtcctggatcaggtggtcggcgggcatgaccaccagggttgcctgatcgccgtgccgtgcctgcacggccagcgcggcggcggcaatcgccggtgctgtgttgcggcccgagggttcgaggatgaagtggccgtggtgctgttccagcccggcggcctggaaatggtccttgctttggaaaaagtgctcacggttggtcaccgtgacgatctcgccgttgccggctagcagcccggcagcacgacggtaggtcttgcccagcaggctctggccgtccggcagggtcatgaagggcttgggctggccttcgcgtgacactggccataaacgggtgccggcgccgccggaaacaattacaggaatcaacatgccttactccttggcaacacgtgtcatgtccgcatccaccatcatgtggatcaggtcctgcagatcggtcttgggccgccagccaaggagcttttgggctttggccgggttgcccagcagtacatcgacctccgccgggcgcaagaacgccgggtcgatcttcacgtagtcacggtagttcaggccgacgtgttcgaaggcgatccggcacatgtcgcgcacggtggtggtgacgccggtggccaccacgaaatcgtcggcctgctcctgttgcagcatcagccacatggcttcgacatagtcgccggcgaatccccagtcgcgcttggcgtcgatgttgcccaggcgcagctcctgctgcttgccctgtttgatccgggcggcggcgtcggtgaccttgcgggtcacgaactcgatgccgcgcaggggcgattcatggttgaacaggatgccgctgctggcgtgcaggccgaagctctcgcggtagttcacggtgatccagtgcccgtagagcttggccacgccataggggctgcgcgggtagaacggggtattttcgtcctgctgctcggcctggatcaggccgaacatttcgctggtggacgcctggtagaaacgggtgtgcgggctgaactggcggatcgcctcgagcaggtgggtcacgcccagtccgtcgacgataccggtggtcaccggctggtcccaggaggcggcgacaaagctttgcgccgccaggttgtagagttcgtcgggtgccgccttgatcaccgcccgttgcacggagcaggcgtcggccatgtcgccatccaggtagcggatctcgccctcgatgcccatctcacgcaagcgccagcacgagtcgctgctgcgtcgcgccaccagtccgtgaacctgatagcccttgtccagcagcaacttggccagataggcgccgtcctgccccgtgatccctgtgatcagtgcactttttgtcattcttgtagtacccgtgactccccgtcggacaggatcgctcgcggggattgttgtataggtgtttcaggcacccattcgctgttcagccgctcgccatggccaccatggacgcgacgcgatgctgtccaccgtggacgggcagggggctggagcgcggtggtggcgacctgggcaagcagagggcggatgttgttgcgctggccagtcaggtggatcgccgggtcgggtgatcggggtaacaggcgctggaagttttggtgggcggtcgggccatgggaggaggcaggcagcgacctccggcctgagccgatgctgctcaagcgggattgggtgtgacgacccatgaatccattcaggtccgttacaaacagacgcttcttcaagcggcagtcccctcatcacgaacttgcgcgaaatcccgggattaaaggcgggaaaattcaggaacttccgaaaactatcgaaaatggcctgccgcgcgaagttattgttgtagttgtttggcagtcaatctgtgccaattgcgcggcaatttcaataagtcctatcgtgaccggtaagttctcctttttgagcataggaaaaatctctccggtaggttcccgaacattcgatggatgtgtttagaatgcccttcgtctcgacccaaacgatcagaggcagctgtctttagccgctggaaactgaccaatagaacaagaacgtagacgggcatgagaacgatggatgcacgcccgcaacacaggcgtggcgccatggctctaccgtcattgtgtgaaggtgccaggatggcggcttcatcgtgagatgccatgaatttcattctttattcggatgttaacgacggctccatcagccagagcctcgggcgtccggaatacagttattacttcgtgctcaaggcttatcgcccggtgctggaaagccttgggcgcgtgcatgtggtgcagacgccggccgaggtcgaccggctgtatcacgagctgcggctcaagggcgaagactgcctgtttctttcgttcaccccaccccagaaaaccccggtcgacctggactgcccgaccctgtgcgtggtggcctgggagttcgactcgatcccccatgaatactgggataacgacccgcaccaggactggagccgcacccttggtcgccatggccgggtgatcaccctgtccagccatacggcccgtgcggtgcgtcgggtgctgggtgagcattttccggtgctggtgctgcctaccccgttgtgggagcgcttcgacggcgtccgcgggcaataccccaatgtaccggtcaacgccggcaccaccctgcagatcaagggctgcatcatcgacagccgggccctggggctttgcgccgacggcctgatcgcgccggtgctggatgaggcgccgccgcctcccgctcccgtcgaggccgaaatcgtcgaagccccgccgctgaccgtcaggcgccggctgttcattgccaagcactatctgcgcgaatggtatcgggcgctggccggcggcgaatggcgccggccgctgttcatcagcaagcactatgttcgcgaatgctaccgcgaggggttgcgcgaccgggttcccgagcgcctgcgggcgctgatggcgaaatcgagaccggagcacgcggcagcgctgcccgtcatcctgccggcacccgcgcctgagccggaacacccccaggccgtcctcccggccaccgaccagcaggtggagttccaggtcgatggcgtggtctatgtcagcgtgttcaaccccgacgacggccgcaagaactggcatcaactgattaccgcgttctgctgggcgatgcgcgacaccgaagacgccaccctggtgttgaagatgacccagaacgacctgtcgtcctattacgtcgaaatgctgaccctgctgtcgcagctgtcaccgttcagctgccgggtcgtggccatgcacggttatctggacgacgagcaattcgcaaggctgtacggcgcggccagtttctacgtcaacgcttcgcgatgcgaaggcctgtgcctgccgctgatggagttcatggcctgcggcaagccggtgatcgcgccgctgcacacggccatgctcgattacatcgacgaggaggtggccttcgtcgtcaagtccagccaggagccagcgatctggccgcaggactcgcgcattctgttccgcaccttgcgtcaccgcccggattggggctcgttgaaaaccgcttaccaggacagttatcgcatggccaaggaaaaccccgcggggtaccagtcgatgtccctggccgcggcccggcgcatgcaggagtacagcagcttcgccagcgtccaggggcgcctgcgggagttcttcgccctgaccccgctgaccgaggccgacggcgtgtcctccctggccgtggcgggtaacgcctgatgctgatcctcatccattcggaaaccaacaagagcaacatccagcagaacctcggccgtcccgaatacagctactacttcgtgctcaaggagttccggccggtgctggaacgcctgggccaggtgctggaggtcagcaaccccgacgaactggtggaccgcctgtatttcgactgccagagccgcggcgaggcgtgcatcttcctgtcgttctcgccgccccatcgcacgcccaaccattacgcctgcccgaccatcccggtgttcgcctgggagttcagcaccattcccaccgaaagctggcagggcgagccgcgccatgactggcggctggtcctgggcaccgcgggcgcggcgatcacccactccagctttaccgtgcgagcggtgcgcgaggtgatgggcgaggactacccgatctgtgcgatcccggccccggtctgggatcgcttcgcccgccgtggcgagcaactgggcaagcagccacgggcgtcccgggtgaccctcaacctgcacggactgttgctcgacagccggaccctggacctgaatgcctatggcccgagcccgctgcgcgaaggctcgcaagtactgctcaatgccccggcccgcgattgccaactgctgctcgacggggtggtctacacctcggtgttcaacccctacgacgggcgcaagaactggcaggacatgatcagtgcgttctgcaccacctttcgcgactgtgccgacgtcaccctggtgctgaaactgacccaccacgatatcggcaacgcgctggccgacatgctgcaccacctctacaagaaccagtcctaccagtgccggatcgtgctgatccacggctttttgtccgacccggactacgagcggctggtggaggccacccgctatgtggtcaattcctcgttcggcgaagggcagtgcctgccgctgatggagttcatgtcctgcggcaagccggcggtggcgccgtgcaacaccgcaatggccgactacatcgaccacgacaacaccttcatcgtcgactccaccgacgagttgaccgcctggccccacgatccgcgggccgcctaccggaccctgcgctatatcaccaactgggattcattgtgctcggcctatcgcgccagctacgacgttgccctgcaggaccccgagcgttatgcgcgcatgtcgagccatgcggtcgaaagcctgcgacgcttctgtagccaggccacggccgaacagcgcctgggcgagttcttccagcaggtgctggagcggcgcaaggtgtctgccgcccccgggcttcccgcgtgatgcgggcgtttctgcggcgtttgcgcaggggcgcgccgttgcctgcgacgctgctggccgaagcgcccaggcccgcggtttctccccgcgattgcggcttgcgcgacgccatgctcgatggctggttccgttccgaaaccggcgagctgctcaagggctttgccatcagcgccgaagacaccctgctcgatgtcggctgcggcgagggcgtggcgacgctgttcgccatgcgccagggcgcttcggtgatttttaccgacagcgagttcgacaaggtgcgcgacctggcccggcaagtcgccgagcaatcggacgtgcccgccctggggctggtcagcaacagcctgccgttgccgctggcccagggctgcgccagcaaagtggtgtgcatggaggtgctggagcacatcgaacagcccgcgccgtttctcgccgagctggtgcgcatgggccgccccggcgcgcagtacctgatcagcgttccggacccggtgggcgagcatttgcagaagggcatcgcgccgcccggctactaccgcgcgccgaaccatgtgcaggtattttcccgcgaaggctttggccagttgatcgaggacgccgggctggtcatcgaacatcggcaggccacgggctttttctgggtcatgggcatgatctttttctgggccagcgaacgggccgccggccgcgagccgccgggcgccgtgcgcgaccgcatccaggcgccgtacccggcgctgatggaaggctgggcacggacctgggaggagttgctggcgcaacccgacgggctggcgatcaagcaggtgctcgatggcttcatgccgaaaagccaggtcatcatcgcccgcaagccgctgtccggcgcagtggctgagccgtcttgaacgacaagcggatcatggacatcgagctgctgcggggcatcgcggtgctgggcgtggtgttccatcatctgcaaggcaatctgtttcgcgatgggctcgcctggttgggcagcgtcgccgcctacggccagttctggtggggcgtggacctgttcttcgccatctccggttttgtcatcgcccgtagcctgatcccgcagctgcgcgcctgcaccagcggcgcgcagtgctggcaacggacccgcgacttctggattcgccgcgccttccgcctgctgccctcggcctggctatggctgctgctgatgttgctggcgagcctgttcctcaatcgttcgggagcgttcggcagtctgcacaccaacctatgggccacggttgccggcctgctgcagttcgccaatttccgtttcgccgacagctttttccactatgagtacggcgccagtttcgtctactggagcctgtcgctggaggagcagttctacctgttgctgccgctgctggtgctgttgtgccgcaagtacctggcctgggtgttgttggcgctggtactcgtgcaggtcctgaccctgcgctcggcgctgctgatggtcatccgcaccgacgccatggccctcggcgtattgctggcgctgtggacggcccgcggcagctaccggcactgggaaccgaagtggctgggacggtatccggggctcggcccgctgctgttgatcctgtcgtgcctgggcctgggctggttggctaccgatggttttaatgtcacccgttaccgggttggcgccctggcggtgctctgcgcgctgttggtgtggatcgcttcctacaaccgcgactatctgctgccccgcggcccgctgaaaagcctgctggcctgggtcggcagtcgttcctacgggacctacctgatccatatcccggtgtttctgctggtccacgaagcctggttccgcctggcgcccctgggcacgaccgggctgaacgagcagccgctgctggcgctggcctgcgccctgggcctgctgctgttgctgagcgaactcaactaccgtgtcatcgagttgcccctgcgcaatcggggcgccgagctggtgcaacgcctgggcacatcccgttctcccgttccttccactggagtcacttcatgctgagccttctgaaaaaactcacggcgagcgctcctgcggccgtagcgcccgacgcaccgccgccggccaaggtcgatccgtacatgctgggcctgcaggacgccatgctcagcggctggttcaaccaggaaaacggcgagctgttcaccggctttccggtgacgaccgaggacaccctgctggacgttggctgtggtgacggcggcaacgtgcattactgcgcgatgcgcggggcgaagatcatcattgccgacatcgacgcggccaaggtcgaggcgacgcgccagcgtctgagcgataccccggcccgcggtgtggaatgccatgtcaccgactgcaacccgctgccgattgccgacggcaccgccagccgggtggtgtctaccgaggtcatcgagcatgtggacgatccggcgcagtttctctgcgaactggtgcgggtcggccagccgggcgcgctgtacctgttgagcgtgccgcacccgagctccgaggacctgcaaaaggacatcgccgcgccggagtatttccagaagcccaaccatatccgcatcatcagcgaagagcagttcaagcagatggtcggcgatgccgggctggaggtgctgagccatagccagtacggcttctactggtcgatgtggatgctgctgttctgggaagccaaggtcgaattcagcaaccccgaccacccgttgctcgaccaatgggcgaacacctggcagaccatcctcaactcgccgcgcggagtgcagatcaagcacgcgctggacgccgtggtcgccaagagccaggtcatcattgcccgcaagccggcctgaaccggcctctgtagccgctgccgaaggctgcgcaaggccgtaggcctttggcgatcttgcgaccctgcgcacccttcggtcgcgatcgtccgaacgcggcccgagcctgcggcagcggctacagggtctgctttaggcctgttgcacgaaagtcaggcgcacggcgaagccgatcagcaggctgccgaacagccattgctggacccgctgggcggcgcggttgtgcgccagccagcggccgatccaggcgccggccagggcgtaggcgctgtcgaacagtaaccccaccagtaccagcagcaggccgaggctggcgaactgcgcggccacggggccggcctgcgggtcgatgaactggggcagcagcaccgagcagaacagcagcgccttggggttgagcaggttggtcagcaggccgcggcggatcgctccacgccagcgcagtgcgctcgcggcctggccgtcctgcaggcagggcagcaggtgggcccgcaggcactgcacgccgagccacaacaggtaggcggccccgcccaagcgtaccacctcgaaggtccagggcgcggccttgaacagggtggccaggcccaatgccgccagcgccacatggcagccccgggcgatcgccaggcccaccgcggtggccagcgccaggcccttgccctggcgggcgccggtttgcagcaggaggatcatgtcggggccgggcagcagatagaccaccgccaatgccaggaaaaacatccacagttgcgccaccttgccaccccctttcgttgtcgattcggtaggtagagtctagggccaagggtagggcaggtgcttgcgtagtcagccagcatgcaggcggaaattggcataatcttccagctgaatatggggtgactatcggaaaatgccaaaaatgaaactggacgcctacgaccgcaagattctcgccgccctgcagcgcgacggccgcctgagcaacgtgcaactggcggaggagatcggcctgtctccttcaccctgcctgcgccgggtacggatgctggaagaagccggggtgattcgcggctaccaggccaacctcgatcgcgatgaagtgggcctggggttgacggtgtttgtcggggtcaaggtcgagcggcacaccgacgagcattccgaagccttccacaaggcggtgacggcgctgccggaggtgctttcggcgttcctggtgtccggcgagtcggacttcctgctgcaggtggtggtgccggacctgcgcgcctacgaccgctttctcaccggcagcctgctgaaactgccgggcgtcagcgatatccgcagcaacttcgcgatccacacggtgaaaaccccgggcgcgctgccgctggggcatttaccggcctgacgcgatcatctgtagccgctgccgaaggctcgggccgcgtttggacgataaggccgaaggccttcggcgatcttgagagcttgcgcgcccttcggtcgcgatcgcagcctgcggcagcggctacaggggcgggaccgggctctacatctgcgtcgccatcccctcgacatccatcgctgcctggcgcaacgcctcggagcgggtcgggtgtgggtggcaggtcagggcaatgtcttcggccgaggcggaaaactccatggccacgcagtattcgccgatcatttcgctgacgctcggtcctactaaatgcacgccgaggatttcatcggtctgcgcgtccgccaggaccttggcgaaaccttcggtctcatggttgatcttggcccggctgttggccgtgaaagggaacttgccggccttgtaggcccggccctcggccttgagctgctcttcggtcttgccgacgctggccagctccggcttggtgtagatcacactggggatcaggttgtaattcacttcaccggccttgccgacgatctgctcgatgcaggccatggcctcgtcctcggccttgtgggcgagcatcggcccggacgtgacgtcgccaatcacccacacgccgggggcctcggtgcggtgctggcggttggcgagcatgccgcgcgggtcagtgctcaggccgacgttctccaaccccaggccctgggtataaggccggcgcccgatggccaccagcacgtagtcggcttccagcagctccgcggtgccgcccgctgccggctcgatactcaactgcacgccgttggccgaggtgctggcgctgctgaccctggtgccgagcttgaaggcgatcccctgcttggccagggcccgttgcagggtcttgccggtttcgccatcgaccccgggacagatgcggtccaggtactcgaccaccgtcacctgggcccccaggcgccgccagaccgaacccagctccaggccgatcaccccggcgccgatcaccaccaggtgccggggcacttcgccgagggacagggcgccggtggagtcgaggatgcgccggttgtcgatctccaccccgggcagtggcgtcggctcggagccggtggcgatcacgatgtccctggcctgcaaccgggtcttgccgccggcgctgtcggtcaccgtgacctggccggggccgtcgatatggccccagcccttgatccagtcgaccttgttcttgcgaaacaggaactcgatgcccttggtcaggccggccacgctgtcgtccttctgcttcatcatctgggccaggttgaggcggggcttgacctcgatgcccagttcggcgaattccttgcccatggccgcgtcgtatagctccgaggcgtgcagcaaagccttggacggcatgcagccgacgttcaggcaggtgccgccgagggtggcgcgaccttcgacgcaggcggccttgaggcccagctggccggcgcgaatggcggcgttgtagccaccgggacccccaccgaggatgacgacgtcgtagctgctcatggctgttctcctgcaatcggaaaagaaggctttaaaggtagtcgagcaaaaaattatgaccgtaatatgagcgcgtaaaacaaccccggtcaagcacgcaattgcgtcttccttgtaggagcgaagcttgctcgcgaaagccgcgaagcggcgtgccgtcaaccggcacgcgttatcgttggcgatcttttcgcgagcaagcttcgctcctacagaagaacggggagcggggtgttcaggtccaccagtagcgcacgaggtggaagaagatcggcgcggcgaaacacaccgagtccaggcggtcgagcatgccgccgtggccttcgatcatgtggccccagtccttcaccccgcggtcgcgcttgatcgccgacatgacgatgccgccagcgaagcccagcaggttgatcagcagggcgatcaggaacgactgccagatagtgaacggggtgatccaccacagcgcgccgccgatcagcgaggccagcaggatgccgccaacaaaaccttccacggtcttgaacggcgacagccgcggggcgatcttgcgtttgccgaagagttttccacagacatactgcaacacgtccgacatctgcaccacgatcaccaggtaggcgatcagcagcaggttgcgcccttcgtagccggcgatgtccagggtcagcagcgccgggacgaacgacacacagaacaccgcgatcatcagcccccactggaccttggaggcacgttccaggaagtgcgtgctgtcgccgcccagggacgcgaggatcggcagcagcaggaacacatagaccgggatgaagatcgagaacagcccgtaccagtcgaagtagatcagcaggtattgcaccggcagggccaggtagaacgccgccaccagcgccgggtagtcgctgcgccgggtcggcatcagggtcaggaactcgcgcagggcgtagaaggacaccgcgtagaacagcaggatcaccgcgctggtgccgagccagaaggcgacgccgatcaccagcaccatcacccaccaggcgttgatgcgcgcattgaggttgtcgatcaccgagctcggcgcgccacggctgcgcagcttgagcagaaaaccaatcagcgaggccagcagcagtaccgcgccgatcccgccgaacaacatcagggtttgcctatccatctcaagaatgctccggggccatggccagcagcgctgcgcggctgcgttcgaggaagtgctctttgctttccccgtcctcgagggacagcggcgcgccgaagctggtggtgcatagaagcggcaggggcaggaaacggcccttgggcatcacgcggttgaggttggcgatccacaccgggatcacctgggcctgtgggtaacttttcgccaggtggtagaggccgctcttgaacggcagcaggccttcctcctccaggttgcgcgtgccttcggggaagatgatcagcgaatcgccgttggccagggcgtcgagcatcggctgcaaggggttatccacaggctccttacgctcgcggtcgatcagcacgccattgaacacgcggttgatgatgtagcggcgcagtgggcgggtctgccagtaatcggcgccggccaccggccgcgtcaccttgcgcagcgcgggcggcagcgaggcccagagcagcacgaagtcgccgtggctgctgtggttggcgaagtagatgcgttgcaccgcctgaggcccgcagccgagccacaggctgcgcgccccggtgatggtgcgggcggcggaggtgatgagggtggcgaccaggggttcgagcatgagaattccttatccggcgatggccagccaggggctggccaggatgaagcccagtgtcagcagtacttgcgccgccagcagccaggcctggcgacgcaacaggttgagggcgccgtggctgcgttgttgccacgggcggccgccggcgttcgccggttgcaggttgagggcgctcagcgcctggtccagggcggcgctgcgctcggccagcggcagcgggctgtccgccacccgctggaacagctcggcatcgaaggccacccgcagcgcccagtacttttgcagcaagcccagcaccagcagggcgacgctcaggacgatggcccagggggcggacacgccgagcaaccactgaccgaagccgagcagggcgccgagcaggctcaggcctgtggataacaggtccagcgaatgcccgcggcgcaacaggctggccaccgcatgcagttccatatcagtggccatgggcgctccccagggctgtggataaaggctccagggcccggcgatgcgcgggttgcaggacgatctgcgggcgcgcgcggcggatctgcacgatggctgcatcgacgctggcggcgcggcctgtgtacaacagccacgcggccacggcggtggcgctacgtgaataacccagggcgcagcagaccagcagcggcgcgtgttcgcgcaggctttcgatggcttgcgcggcctcgcggcattgctcggtggtgggcgcggtcaggtcgagcaccggcacgcagcgataggccaggtggcgaccgtccacggacagttcggcacacaggtcgagcaccgcgctgaacgggctgtcctgcagctcgcccggggtcgggacgcgcccgagccagacgttatccacaacctcgtcgggctgtggatgcttgtgtgtccacagccgggaattgatccaggccgccgccagataaggcgccagcagccagcgcgtggcgttgcttaggcggccgtccgcgcccttctggaaacccttggcgtcgaacagcccatagttcagcgccagcagcagcagggacaccgccggccatagcagccacagccaggccccgccgcagatgaaggccgggatggcgagcgccacggcgccgagggcgtagcgcaacgccaggcgccagcgctgacgatcgcgggccaggcgcaggttctgcagcatgccggggcggtccagcggccacagccagacgcacagccagccggccagggcgcctgtgggcacgtcgataaagtggtgttgataagtggtcagcaccgacacgccgatcagcgcgaaccagccgtgcaccagccagcgccaggcgccctggacatgccgcgcgtagcagacccacagcaccaccagcagcgcgatgtgcagcgatggcgcctgattgaacggcttgtcgaagccggccagcacgtcgaacagccaaccgaacaggccatccagttccgggcgctggaaggtgaaacgcagcggccagagcaagaagcaactgacggcgatgacttgcgcggtcagcagcctcagggcgtggcgcttgagttcttcgcggctggtgggcaacagcagggaaaagccgtacagcaggtcgatcgaccagtagggcacgatgctccaggcacagaacggcatctgccgctcccagtcgaacaccaggctgccgacctcggcccgttgcgcggtgacccaggtggcgaagccgtaggtgccgaaaaacagtggcgccagcagcaacagccagagcaccgcgggtttcagcaggccgggctcgcgggtgtatgtcgcggcaaccgtcatcattgcacccgctgcgccagcgacacgctgaaaatgccccactgatcgacgcgcagggtgatccggcggaaccccgcggcttccaccagttggtccatctcggcctgggtccggcgacgcatgacccaggcctggcccgcgcggtggctggtcagggcgcgggcgatcagctccagctgcgggtgccacggttgcccggtgtagaccaggtaaccgccaggctccacggcggcggccaggcccgccagggaatcgctgaccatctggttgtcggcgaacagctcgtacaggccggagaccaccgccagtgtcggtttgggcgccagggccgcgaggtcgtcgcggtcgaaggcgtcggctttgacgaagcgggcaatctcgcccaggcctttctcggcgatcaacgcgctgccgtcgcgcacgttgatgtcgctgtagtcgcgcagcaggatcgactccggcagcgggctgaccccctgcaaggcttcgagaatgtagcgcccgtggccggcggcgatgtcgacgatgcgcacttcgcgctgctcggcgcgcagtttttccatggccaggcgcagcagttcttccacatgcagcttgcgttggcgaataccgcgccagccgatggaatccaggtagttgcggtcgatcatccggcccagggccgaggtgccggtcgcttggttgcggtacacgtagtccagggtgctgccggagtcgaaaccgctgtcgaaacccagcttgaccccggccgagagctggctgcccagacgcatgctggcgcgggtcatgcgccagtacaggtcacgcagggagttgtgcggcaggggcgccgccagcgcctcggactcggcgcaggtcaggcccaggcggtcggcgtcgagcagggccgggcggttcagcggtcgcgcgaagttctgcaggatgaagcgccgggcgctggcgacggccggggcccgggccttctcgccgagggtgtcgtggaagaagcccggcaggaggtgtttttccttgtgcaggctgcccaggcgctcgaagaactgttcctggggccggcgatggacgacgaagtcggcgccggagatcagcaactgggtcggcacctggatcgcctgggcatcggccaccacccgttcggcggcttcgtacaggcccagcagcacgttcaccgagatcgccttggtgatcagcgggtcgctgtcataggaggccacgcgcgccgggtcgtggctgaggaagcgcgccttgacgtagctgttgacgaaaaagttgccgcgaaaacgccgcatcagcgccaggcccgggcgggcgaaaggcacgtagagcttgaccttgaacgccggcgacgccagcaccagggcgcggatgcgcggcgcgtaatcgtggacccaagtggcggcaatcaccgcgccgacgctttgggccaccacggccatgtgttcttcgtcgatgccgtggctggcccgcaggtgatcgcagaaggtctgcacgtcgcgcacgctggtggcgaagctcgggctgtcgccacgggcgccgggcgactggccgtggccgcgggcatcccaggcgaagaaatcgaaggctggcaggtccagttcgtccaccaggtgggcgatgcgcgcggagtgttcgtggccgcggtggaacagcagcacggcctggcgcggggcgtccgagggggcggcagtggccggccagtggcggtagaacagctcgacgccgtcgtgggtggtgaaggtctggtggagagcttcgcgcatggcaacttccttattccgagggggcgttttgctggacttcttgtcgttgggtgtcttgctgttgtacgtcgagcaggccctggcggacccggttgatcaaggtgtagaccaacaacgcggcgaccagcgccagcacgccgttgatccaggcggcgctcagccagcccagggcgatgccggtggccagcacgccgagcacgaacgcccggtcgctcttgcccatgggcccgtcgtagcggcgcgaggcgccgatcatcggccccagcacgccggcgtattcgctgaacagcgccagcagcgtcaccagcaggaccagcggcaggctgacgccggcaatcagtgcgaagggcaggatcagcgcactgtcggcaatcacgtcgcacaattcgttgaggtaggcgcccaggcgcgattgctggccgaattcccgggccagcatgccgtcgatagcgttcagcgccatgcgcaggatcatccacagcgggatcaggatgaacagccagaggtggctggcgaaactggcgatcagggcgcccaccagcaccgaaatcactcccgccagcacggtgatctggttggccgtggtgccgttgtcgtacaggcgctggacccatggccgcagcaggttctggaagcgcggtttgagctggtagatggagagcatggctggacgtttccttgtcacaaagtgggccacggattatggccccagatctcgcgggctggcatcagcacagcagcggttttccctgggtttgtgacgcgcccatggcaaataaaggcataggtaagggacgaaaatttcactactatcgttatatcgtaacgatttgtgacaaatacagcggcctgccggagagttatccacaggccggaatgggttaacgaccagcgttggggtgctatgcaagtcgatcttgagactgaaggggcgggggtcgaagccttgccgaggtttcagcgggcggcctttcacgaacgccgtctgaagcgttggggcatcgggctggcggggctggccggggtggggctggtgttggcgtttttcgtcggcctgtttgccccgcaatccttatggccggcgttgctggtcaatctggccgcggccttgctggtgctggtcggcggcctgcaggcggcgggctgggtcagtgcctggcgcgcggatgcattgcggacgccggaggtggcgccgagcccggagccggttgcggatgaaccgttacccgacgacggctggtacgagcggctgctggagggcatcagccgacgttggtccagtttgttggcgcagatcggcgcgctgaccttgtggctgggcggttgggccttgctggtgctgttggtgatcgagcaggcgtggaacctcggcctgcccgcagcgagcctgggcctggcgggcaatgtcggcgcggtgttggcgctgttgctggccttcggcttgctggtgttcgagcgccaactgagccaggaacaccccggcgaatggccggaagccgcggcgctggcgcagttggcgcgagtggcgatcatcagcctggtgctggcggcgctgtgcctgttgttcagcagcgacacggcgctctggccggtgcgcctgggcgtgctgatcggcgtgttgccggcgttggtggccctggagttcctgctgcgcgcggtattgtcgttgttcagcccgcgtcgcgcgcaactggagccgcgcatgctggcccacagcgtggtcgccgacctgttgcgctggccgccgcaacccttgctggccttgcagcacgaattgcacaaccgcttcggcatcgacctgcggcagatctgggccttcacttatatgcgccgcgcgttcctgccggtactgctggtggtgctcggggtgggctggctgctcaccggcctgcacgaagtgccgttgcaggggcggggaatctatgagcgtttcggcaagccggtggcggtctttggcccgggtttgcatgcgggcctgccgtggccgctgggccgggtgctgagtgtcgagaacggcgtggtgcacgaactggccaccagcgtcggcgaagcgcccagcgtgatcgaaccggcctccgccgaagggccgcccccactggtggccaaccgcttgtgggacgccagccatgtcaacgacaagtcccaggtgattgccagcggcgctgccaacaaacagagcttccagatcgtcaacatggacgtgcgcttcgtctatcgcatcggcctgagcgatcaggcggcgctggcggcgacttacaacagcgccgacatcccgatgctgatccgcagcaccgccagccgcatcctggtccacgacttcgcctcgcgcaccctcgacggcttgctgggcgaagaccgtaccaacctggccgaggacatcggccgcgcggtgcaggccgacctggagaaactcgacagcggggtggagatcctcgccaccgtggtcgaggccattcacccgccggccggcgccgccaatgcttatcacggcgtccaggccgcgcagatcggcgcccaggcgctgatctcccgcgagcgtggcgcggccagcgagcaaaccaaccaggcgcaattgcaggccagcatcgcccgcgatcaggcccaggccacggctcatgaagtgcaggccacggcgcaagcggccgacctgcggttcagcgccgagcaaaaggcctatgccagcgccggccaggcattcgtgctggagcagtatttgagccagctgagccagggcctgcgcaacgccaagttgctggtgctcgatcatcgcctgggcggcgccaacgcaccgaccctcgacctgcgtacattcactttgccgaccgagccttcggtaccgggtaacaccgctcagccaggagccgcccattgagccagtcccattcccacgatcatcaggatcacgccggccacgatcacggccatggcggccatcaccacggacaccatcatcaccaccacggcgcgccggaagaggcggggccctttccctggcggcgcatggcctgggcgctgttgctggtgttgttcgccgtcgccgcggcaagcctggtacaagtgcgctccggcgaagccacggtgattacccgtttcggcaacccggcgcgggtgctgctggaaccgggcctcggctggcgctggccggcaccgttcgaggcggcgatcccggtggacctgcgcctgcgcaccacctccagcggtttgcaggatgtcggcacccgcgacggtctgcgcatcatcgtccaggcctatgtggcgtggcaggtgcagggcgatgcggacaacgtgaagcgctttatgcgcgcggtgcagaaccagccggacgaagcggcgcggcagatccgtacctttgtcggctcggccctggaaaccaccgccagcagtttcgacctggccaatctggtgaacaccgatgccagcaaggtgcgcatcgccgacttcgaagcccagttgcgcaaacagatcgaacagcagttgttgagtacttatggcgtgcgcgtgctgcaagtcggcgtggaacgtctgacgctgccctcagtgaccctgaccgccaccgtcgaccgtatgcgcgccgagcgtgaaaccatcgccaccgaacgtacggccatcggcaagcgcgaagcggcgcaaatccgttccgccgccgagcgcgatgcgcgcatcgttcaggctgatgccacggtgaaagccgcggacatcgaagcgcaatcgcgggtgcaggcggcgcagatctacggtcgcgcctacgctggttcgccgcagctgtacaacctgctgcgttcgctagacaccttgggcactgtggtaaccccaggcaccaagctgattctgcgcaccgatgccgcgccgttccgggtgctggtggacgggccgccgacgctcggcaataaagccgccgggtcgcaaccatgagtttggttccacgtggaacacatgaactgggcagcccatggattcaggccggtcgcctggcgtttctcgccctgtatgcggtgaccgtgctggcagccctggcttgggcgttttccaatgtgcggcagatcgatccacagaatcgcgcggtggtcctgcattttggtgccctggatcgcattcagaacgccggcttgttactggcctggccgcagccgttcgaacaggtggtgctgttgcccgccgcagaccgggtgatcgaacgccgggtggaaagcctgctgcgttccgatgcggccttaaagggtgacaaggtggcgagtttcgccgtgcccctgagcgatgccctggctggctccggttacttgctgactggcgacgctggggtggtgcagctggatgtgcgggtgttctacaaggtcaccgagccttatgcctttgtattgcagggcgagcatgtattgccggcgctggatcggttggtgacccgcagtgccctggccctgaccgccgcccgcgatctggacaccattctggtggcgcgtccggaactgatcggggccgacaaccaggccgccgagcgtcgcgaacggctgcgtggtgatctagtgcaaggcattaaccagcggctggcggatctggcggcgaccgggcagggaatcggtatcgaagtgacccgggtcgacgtccagtccagtttgccggggcccgcggtcagcgccttcaatgcggtactgactgccagccagcaggccgacaaggcggtggccaacgcccgcaccgaagccgaaaagctcacgcaaaccgccaacgaacaggccgaccgcaccttgcaggtggcgcacgcccaggccggtgaacgcctggccaaggcccaggccgataccgcgaccatccagggcctggcccaggcgcaacgcaatggcaccgacccggaaatgctcttgcgtatctaccgtgagcgcttgccgaagatccttgggcaggccggctcggtgaccacggtcaatcccaaagacgattcccgcctgatcattcagggagcccaaccatgactgttcacacccatgccgccgcgccggcgagcatgctcacctctgccgaacaacgcagcgccgcgcgtcagctgaccctggccatgctcgcgttggggctgctcggcctgggcctggcctggcgctggctggcccctgagcagaccggcgtcagccagttgctgctggggttcgcctcgttgctggtggcgctaccggtgatgcgttcggcctggtacagcctgcgctacccgagcctgcatggcatcaccgaccaattgatcgccctggccatgctcggcgcctgggccaccggcgacctgctgaccgcggcgctgttgccgatcatcatgatcttcggccacgtgctggaagagcgcagcgtcatcggctcccaggaagccattcatgccctgggccgcttgacccgcagccatgcgcgacgggtgcaggccgacggcagcattctggaagtggacaacgccacgctcaaggccggcgatatcgtcgaagtgcgcgccggcgaccgggtgcccgccgacggcctggtgctgtccgggcaagccagcctcgacaccgcaccgatcactggcgagtcggtgccgctggaggccgatgtcggcatgcaggtgttcggcggggcgatcaacctcgacggcctgttacgcctggaagtgacccgcaccggccacgaatcgaccctgggcaaggtcatcgcgctgatgcaaagcgccgagcgttccaagccgccgatcacccgtttgctcgaacgttacgccggcagctacatggtgctggtgttgctgctggcggcggtgacctggttcatcacccacgatgcccaggcgatgctcgcggtgctggtggcggcctgtccctgtgccctggtgctgtccgcgccggccacggcgattgccgggatcgccgtggcggcgcggcacggcatcctgattcgtagctcggcgttccttgaggaactggcggacctgacctcgctggtggtggacaagaccggcaccctgaccttcggcaccttgcgcctgcaatcgatcgacagcccgcgggaggatcgccaggccttgttgaacctggcggcgagtctcggctcggccagcagccacccggtcagccgcgcgctggccggcctggtggcccaggagcatttcctggtgttgtcggatattcgcgagcgccaggggctgggcgtggtggcgcagaccgaacagggcgaggccgccctggggcgtcccgagttgttcggccagctcggcatcgtcaccacggcggtgcccgaacatgacggtccgattgccgggctggcgctgaacggtgagtttctcgcctggctgttgctggccgacagcgtcaagccggaagcgcgttttgccctcgacgagctgcgcgaactggggctgggccgccagctgttgctgaccggcgaccgccagagcgtggccgacagcctggcgcgggatgtcggcatcggcgatgtcgaagcccaggcgctgccggaagacaaactcaagcgcgtgctgggggaaatcgacagcggtttccggccgatggtggtgggcgacggaatcaacgattccctggcgctcaaggccggcgtggtcggcgtggccatgggcgcgggcggggcggacattgccctggcgtcggccgatatcgtgctgatcggcagcgacctgcggcgcctcggtacctgtgtgcgcctgagccgccagtgccgccagaccctgcaggtcaatgtgatcatcggcctgggctggactctggccatcgtcgcctttgccgcgttcggctggcttggcgcggcgggggcgatgatcgcggcgctgctgcataacctcagcaccttgctggtgctgggcaatgccgggcgtttgctgcgtttccaggagccattgctcaagttgtaggggcgtgggccggggcggaaagcgcgggtttgagcgtctggagctagaattaaaccaggtcgaactgtgcgcccgcttggcggtcatctgtgaagagggcccagcttccgggacggtcggctggctgttcagcagggattgtggcactgccggcactgatgaatttcagctatcagatcgatagcctgctaatttttcagtatggtctaacctcactcagacgtctgaaacaagggggattatccatgctcgcgcaacttccaccggccttacagaatctgcaactaccgctacgcctgcgactctgggatggccacgagttcaacctggggccggcgcccagcgtcactattgtggtcaaggacccgcaactggtcacccagctcgcccatcccactctcgacgcgctgggggcggcgttcgtcgagggcaaacttgagctggaaggctctatcagcgaagtcatccgggtttgcgatgaactgagccaggcactgctggacggcgaggaagaagcgctgccggtacgttccctgcacgacaaggccaccgatgcggccgccatctcctaccactacgacctttccaacgacttctaccagctgtggctcgacagcgacatggcctattcctgcgcctatttcgagaccggcagtgaaagcctggaacaggcccaacaggccaagtttcgccacctgtgccgcaagttgcgcttgcagcccggcgagtacctgctggatgtcggttgcggctggggcgggctggcgcggtatgcggcgcgagaattcggggtcaaggtcttcggtatcaccctgagcaaggaacagctggcgctggccagggagcgggtggccgccgaaggcttgcaggacctggtggaactgcaattgctggactaccgcgacctgccccaggacggccgtttcgacaaggtggtgagcgtcggcatgttcgagcacgtgggccacgccaacctggcgcagtactgcaagacactgttcggcgcggtgcgcgaaggcggcctggtgatgaaccacgggatcaccgccaagcacaccgatggacgtcccgtgggccgtggagccggcgacttcatcgagaagtatgtgttccccaatggcgagctgccgcacctggcgatgatctcggccgagatcagcgaagcggggctggagatcgtcgacgtggaaagcctgcgcctgcattacgcccgcaccctggaccactggagcgagcgtctggaagacaacctggaagccgcctcccggctggtgccggaacaggccttgcgcatctggcgcctgtacctggccggctgtgcctatgccttcgcccgcggctggatcaacctgcaccagattctcgcggtcaaggctcacgctgatggcagccatgagctgccctggactcgcgacgacctgtattactcatgaaacaccgacgctaaagaatcggtgaaataagccgggcgacccgcatgccaagctgttgcaggcggtgggtttcccggctttcttctttggcgatttcgcgggaacgctcgaagtcgaggttgagcatctgttccacctccctggcgaaggcttcgtccacggtcagcaacatcacctcgaaattcaggcggaacgagcggttgtccaggttggcgctgccgatcgcgctgatttcgctgtcgatcagcaccactttctggtgcaggaaaccgggctggtaacggaacacccgcaccccggcgcgtacggcttcgaaggcgtacaggctggaggccgcgtagacgatccggtggtccgcgcgcgacggcaggaggatccgcacatccaccccgcgcagggcggccaggcgcaaggcggcgaacacggcctcgtcggggacgaaataggggctggtgatccacacccgttcggtcgccgcgtggatggcttcgacgaagaacagcgagcaggtttcataagggtccgccgggccgctggccagcacctggcacagcacgccgtcgtcggggtaggtgtccggcaggatcagcggtggcaattgccgcgaggcccagaaccagtcttcggcgaaggattcctgcaggcaggccaccaccggaccgctgaccgaaacatgggtatcgcgccagggcgccagaagcggttttttccccaggtattcgtcgcccacgttatgcccgccgacaaaccccagcaggccatccaccaccactatcttgcggtgattgcgaaagttgatctggaagcggttgagccagccgctgcgggtggcgaaggcatgcacctggatgccggcatcgcgcaggggctgcacataggcgtggggcagggagtggctgccgatgcggtcgtagagcaggtggatcgccacgccttcgctagcctttttcagcagcaactcttgcaggcgtcggccaagatcgtcgtcgtggatgatgaagaactggatcagcaccgccgtgcgggcgcgttcgatggccgcgaaaatcgcggcgaaggtggcatcgccgttgaccagcagttgtacatggttgctggccaggcagggcatgcgccccagcttgggcatggcccgcagcgaggtgtaggcggcggaggcgcgggcgctcagggcctcctcgatccaggggcgccagttcagctcgttgatcgccttgcgcatctccaggttggcctggcgccgggccttgatataggcatcgaaggtgctgcggccgaacaccagataagggataagggtcaggtacggcatgaacaacagcgacagggcccaggcgatggagccttgggcggtcctgacggtcagcacggcgtggatggcggcgatcaggccgagaaagtgcagcagggcaatcagatagccaaaaatatgtgggccaaaataatccatggggacagccttgctcctgaagattcaatgctggggtccgtatgaaaagcggcgcgccgggcgccttcggcgctacgtgcaaacaggcgcggccttgctcgccaactcttcgttgcagaccctaacagaccatgttcgagcatgattgtcgctaattaattcgccatgcaacgccgctgcatttttggcgtctaacggccactactgtctaggagtcattcgatgaagcttcgtctactgggtttggccatggctgccgttgtctcgcttccgctggccgcgcaggcccagatgctgcaaccgggcctgtgggaactgaccaccagcaacatgaaagtcgatgaccagagcctgccggacctgtcgttgattctcggccagttgcaacaacagctgacgcccgagcaacgggcgcagttggagaagcagggcgtgaccatgggcggcaagggcatccgcgtgtgcctgacgccggagcaggtgaagtccgacaccatcccgctgcaggacccgcaatcgggttgccgccaggaggtcaccgaccgcacctccaaccagtggaaattccgcttcagctgcccgaaagcccagggctcgggcgtggcgaaattcctcagcgatcgtgagttcaccaccaacgtcatcggcaccttcaatgccaccggcttccagcagaagggcagcatggatactcgtgcggtgtggctggggcaggattgcgggacggtcaagccaagagcctaagagcatcgcgagcaagctcgctcctacaggggatcgtattaaacctgtaggagcgagcttgctcgcgatggcgtctgtcgctacaactccacccgcaagcgctccaccacctcgctcaccgcccaccgccccaggtcctcgccattgcggctgcgcaagctgacaaatcccccgtccttttccttgtcgcccaccaccagcaggtacggcaccttttgcaggctgtgctcgcggatcttgtagctgatcttttcgtttcgcaggtcggcaccgatccgcaggccctggcgctgcagggtatcggccaccgaccgggcatagtccgcctggccttcgctgatgttgatcaccaccgcctgccgcggcgccagccagcagggcagggcgccgctgtaatgctcgatgaggatgccgataaaacgctccagggaaccgaacagcgcgcgatgcagcatcaccgggcgctggcgttcgccgtgctcgtcgatgtagctgatctcgaagcgttccggcaggttgagatcgacctgcagggtgccgcattgccagtcgcggccgatggcatcgcgcagcacgaactccagtttcgggccgtagaacgcgccttcgccagggttgatccggtagtcgatcgccatcgtttccagggcgccggacaaggcgccttccagctggtcccacagcgcgtcgctgccgatgcgatgggccggccgggtggagagcttgaccgcgacgtcgtggaagccgaagtcgcgatagatgtcgaagaccagggcgatggtgctcgcgcattccgcctgcatctgcgccggggtgcagaagatgtgcgcgtcgtcctgggtgaagtggcgcacccgcagcaacccgtgcaacgcgccggagggctcgtagcgatgcaccttgccgaactcggcgatgcgcagcggcaggtcgcggtagcttttcaggccgcggctgaagatcgacaccgcgccggggcagttcatcggcttgagggcgaacacccgctggtcttcggtggtggtgctgaacatatggtcgcggtagttctgccagtgcccggaggtttcccagaggctgcgatccatcacatccggggtgttcacttcctgatagccggcctggtcctggcgccggcgcatgtagccgatcagttgctggaacagggtccagcccttggcatgccagaacaccgagcccggcgcgcagtcgtcgaagtggaacaggtccagttgctgtccgagcttgcggtggtcgcgcttgccggcttcttccaggcgggtcaggtaatccttgaggtctttctgagtggcccagcaggtgccgtagatccgttgcagcggggcgttcctggcgtcgccgcgccagtaggcgccggcgaccttggtcagcttgaacgcctggaggatgccagtgaacggcacgtgggggcctcggcacaggtcttcgaaatcgccctggcggtacagcgacagcacctggtcctgcgggatgtcgcggatcagctcggccttgtagtgctcgcccaggctggcgaagtattccagggcgtcgtcacggctcagctcgcgccggcgtaccgcatggttggtcgcggccaggcgggtcatgcgcgcttcgatgcgctgcaggtcgtcgggggtaaagggccgttcgtaggcgaagtcgtaaaagaagccgtcctcgatcaccgggccgatagtgacctgggccgaggggtacaactccttcaccgccatggccagaagatgcgcgcaggagtggcgcaggatttccaggccctcgggctcgcgggcggtgacgatgctgacccgggcatcgccctcgagcacgaaagagcaatccaccagtcgatcgttcacccggccggcgacggccgccctggccaggccgaggccgatgctcgcggccacctcgtacacggaaagcggctggtcgtactcacgttgtgagccgtcgggcagggtgatgtgaatcatcgggtgttccttggtgttccaggggagggattcagggaagggatcagcgggtaaaacgcagcggcaggccctggcagttgtcgtacaggcgcccggcgtgccaggccagttgccccgacaccagggtggtgtcgacgctatggcggaaacgctgttcggcgaagggcgtccagccgcactgggcgaggatcggttgctgggccacggcgaggccctcgggctcgggcctgatcaataccaggtcggcccagtagccttcgcgcaggtagccgcggtcgggaatggcgaacaggtcggcgacccggtggctggttttctccaccagggtggtgatgggcagcacgccgtcggccaccagttccagcagggcgggcagggcgtgttgcaccagcggcagcccggcaggcgcctggcggtagggctgctgtttctgtgcccaggtgtgcggcgcgtgatcgctgccgatcacatccaggcggttgccgagcaaggcctggcgcagggcgtcgcggtcggcgcgggtcttgatcgctgggttgcatttgatcaggtgcttgaggcgcgcgtaatcacggtcgtcgaacagcaggtggtgcaggcagacttcggcggtgatgcgcttttgcgccaggggctggtcttcgaacagttccagttcgcgggcagtggtcaggtgcaagacatgcaggcgcgtgccgtgacgcttggccaggtccacggccagcgacgaggagcgatagcaggcttcggcatcgcggatcagggagtgggccacggcgggaatcgcttcgccgaaacgcgcctgcatgcgctgctcgttggcctggatgctgggcgtgtgttcgcagtgcgccaggagaatggtcggcacctcggcgaacaaccgctccaggacctgcggatcgtccaccagcatgttgccggtggaggcgcccatgaacactttgaccccggccaccaggcacgggtcgagggcggcgaccgtgtcgaggttgtcgcggctgacgccgaagtgaaagccatagttggccaccgagtggatcgccgcccggcgcttcttgtcctccagcgcggccagggtcagggtcgcgggctgggtgttgggcatgtccatgaaactggtgatgccacccgccacggccgcccgcgactcgctgtggaagctgcctttctccggcgcgccgggatcgcggaaatgcacctgatcgtcgatcatgcccggcagcagccactggccctgggcatcgatctcggtgcgggcattctcgccttcgatgctgctggcgatcttgacgatgcgcccatggtccaccagcaggtcggcgtcgaactcgcgtccttcattgaccagccgggcgttgcgaatcagcacgctgtgcatgttcagaactcgttctgcagggctttgtaaccgcgcaccagatcgacgttggtgcgcgccacgtcttcggaaaactccgaggcgctgatgctgaccggcgggaactgcgagaggtcggtattgggcccgatgcgggtggtggagggcacgtagaagccttgcggcaggtcgcggccatcaaccaccgagttgtgccgcaccacgctgccgttgccgaccgcgcaattgaacagcacgctgttgaagccgatgaagacccggtcgccgaccgtgcacgggccatggacgatggagcggtgggcgatggaggtgaactcgccgatggtcaccgccgcgccggatttggagtggatcaccacgccgtcctggatgttcgaattggcgccgatgacgatcgggtccatggcgccttgttcgttgacttcgtcggcacggatcaccgcgtaggggccgacgaatacgttctcgccgatcaccaccttgccgcagatgatggcggtcttgtcgacataggccgactcggcgatgaccggcagatcgccggaggggttcttgcgaatcatgctggggtttcctgtagcggcgcgctgatgacctgcaccgcgccgttgcgaatggcgttgtagaaacagttggggcgcccggtgtggcaggccgggccttgctggtccaccagcagcaggacggcgtcgccgtcgcagtccaggcgcgcttcgagcagacgttggcggtgccccgagctttcgcccttgcgccacagttgccggcgcgagcgcgaccagtagcagacgtgcccgctggccagggtctcggccagcgccttgcggttcatccaggccagcatcagcacctcgccgctgtcgtgctgctgggcgatggcggcgatcaggccgtcggcgttccacggcagcgcatcgagcactccggtgagcggccaacggctgcccgggggcgcgctttccaggtcgagcatcgacagcggtgggcgcttgttcatggctggctcagggcgtcgtacagggtgttcaggttgtattcgaacaacccggtgaacgtgctggccgggccctgggcggcgagggcatcggaatacagggtgccgccgatatgggcgccgctttcgtcggcgatctgcttgagcaggcgcgcgtccttgatgttctccatgaacaccgccttgaccctggcgttgcggatctgggtgatcagcgccgcgacttcggcggccgagggttcgcgctcggtggacaggccttgcggggccatgaagtcgatgccataggcctgccccaggtaaccgaaggcgtcgtgggaggtgacgatcttgcggttgcccggcggcagcgcgccgaacttggccttggcctcggccagcagcgcgtagatccgtttcaggtaggcctggctgttgcgctggtagtcggcctggttcgccgggtcggcggccaccagtgccttggtgatgttgcccacgtagagttcggcgttcgccaggttgtgccaggcgtgcgggtcgggcacggtctcgccatcctcatccagcgagcgcggaatcaccccgcgactggcggtgatcaccgtggcccgggtgccggtgctggccaccaggcgatccagccagggctcgaaacccaggccgttcttgatgatcagccgggccttgagcagggccttggcatcgtccggtgtcggttcgtaggtgtgggcgtcggcgtccgggccgaccatgtcggtgatctggatgtgctcgccgccgacctggcgggtgatgtcggcgaggatgctgaagctggtgaccacggcgagtttgtccgcggcctgggcgggcgacagcgacaacggcagcaacagactgaagagcacgagtagggcacgcatcggggaacacctcatggggatgtgagcaaaggcgggcggcgcagcagaccgtgcaccggaccgaacaccacggacagcaggtacaggccgcccgccaccaggacgatggccgggccgctgggcagcgagtagtggaacgacagcaacaggccgagccacaccgagaggcaaccgagcagcgcggcgatgccgatcagcaccggcaggcggcgactccagaagcgcgaggcggcggccggcagcatcatcaggccgaccaccatcaaggcgccgatggcctggaaaccgatcaccaggttcagcaccaccagggtcaggaacaggccgtgggcgagggggccgaggcggctgacgctgttgaggaacagtgggtcgagggtgtccagcaacagcgctttgtagatcagcaccatggccagcaggctgaacccggagacccagagcatgccctccagggtcggcccatccaccgccagggccgagccgaacagcaggtgcagcaggtccaggcgtttgccggcgaggccgagaatcagcacgccgctggccagggaaattgggtagatcgcggccaggctagcgtcctcgcgcaagccggtgcgccgggtaatccaggcggccaggccggccatgccgagtccggcgccaagaccgccgagcgtcagtgccggcaggctcaacccggcgaaccagaagcccagcgccgcgccggggaggatgccgtgggccacggcgtcgccgatcaggctcatgcgccgcaggatcagaaacactcccaacggcgcggtgctgcatgccagcgccaggccgccgagcaatgcccggcgcatgaacacgaactcgtggaagggctgccaaagctgggcggcggcgagcatcaggccacctgcatctgaatgggctggacgatcagttcctcgctgctgccgaacaggcaaccgctggctttgatcagcagggtctgggggatgtgctggcgcacggcggcgaggtcatggcagaccacgatttgcgtgcgaccttgctgctgccaggtgtggatgtgttgccacagcagggcctggcccagttcgtccagggcggcgtggggttcgtccagcagcaacagcggggcatcggcgaggctcaggcgggcgagcagggcacgctgcaattcgccaccggacagggccatcagcgggcgttgttccaagccgctcaggcaccagtcagcgagcacctgttgcaagcgttcggcacgctgttgcgcgctttgccgatcgccccagaaaccggcggccaccagttcctgcagggtgatggggaactgtcggtcgaggtattgctgctgcggcagaaaggacaggccgccacggcgagggaccagcaacttgatcttcccggccaagggcttttgcaggccggcgatgaccttcagcaggctgcttttgcccgagccgttggcgccaatgatggcggtcaggctgctgggctccagctcaaggtcgagcgcaggcgtcagcggttggccgggcgcgccccaacgcagcgattgcagactgatcatgcgagctcccagttccagcggctctcggccacggcgtcatgggcgtgcaggctttcggcatgcactacgcgtacctggaaggcgcggatgcctggcgaacgttgcaaggcgaggttcaggcggcgcgcggcgtcttcgcagaacatcaggttttgcccgttggccagggcgaaggcttgttcgtcggcgcgtttcaccgcggtttgcacggcggtgccgagggcggcttcggcgtcgttgatagccgccatcaacggcaactcatcgagaaagtcatccaggcgcagctgcaattgcgcggtgctgcgctggctgtggggcgtggcgactatgcctttcgaggagccgagccagggcaggatgtcttcatggtgcaatgcccggttggcgaaatcatcgatgaattgctgctgaatcagctgcctggaaagcgcggcggaacaggggcacgtcgaggaataaggcacctcgatttttagttccacgtggaacattgcgtttttcagacgcgcttcgatgctcaccggataggttttccagccggccaacgggctgatcaaggccgggcgtttcagcagcagatcggcatgaattcgcaggtaggcactgctggacagaccgtcgtggctgtcgagaaaacgttgcagtacctggcgcatcaggaccggggtgaggttttcctgttcgagcatttccagcgccagatacagccgcgacatgtgaatgccgcgggcttcgccgtcgtcgaggctgacgccggcatccgctgttgcgccaatccgctggccatcaaacaacacaggtaaggcaatgccacacatgcccacccactcaaggggcagggcctggcgtgcggcctgcgcggcgatatccggcagagtcagcgcattcatgagcaggtccatcgttggaaacaattcgccatgttatattataacaattcggtcgatgaaacctttttcctgaacgttttttcaccaagccttatcgagtacggatgctcctcaatctgcggtgtaagtcatgcacagacgtcagttgctcaacctgctgttggccagcgcggccttggttctgcctttgggggtatccgccacccagattcgcaacctgcggttatggaactcggccgacaagctgcgcctggtgctcgatctgagtgggccggtgcagtacaagaccttcactctcagcgcgccggagcggctgatcatcgaccttcgcggcgcgcagctcagtggcgatttcagccaactggccctggccaacacgccgattcgctcgatccgttccgggcactttggccagggcgatacgcggatcgtcctcgacctcgccgaaccgctgcggctcgacagttttttgctgccgccccaggacggccagggccaccgcctggtgctcgacctgagcaatgccagccgtgccccgcagcagatcgcggcggtcgccgctcccgttttgccgcgtgaaacaccggcggaccggatgcatcccaagcgcgacatcatcgtcgtggtcgacccgggtcacggcggcaaggatccgggggcggtcggtgcccgtggcgaacgggagaaagatgtggtgctggcgatcgcccagctgctggccaagcggctgaagcgcgagaagggcttcgatgtgaagctggtgcgcaacgacgatttcttcgtgccgctgcgcaagcgggtggagatcgcccgcaagcacaaggccgacatgtttatctcggtgcatgccgatgcggcgccacgcctgacggcgtccggggcttctgtgtatgccctgtccgaaggtggcgccacctcggccaccgcgcgcttcatggcgcagcgggagaacggcgccgacctgctgggcgccaccagcctgctcaacctgaaagacaaggacccaatgctcgccggggtgattctcgacatgtcgatgaacgccactatcgccgccagcctgcagttgggcggtaccgtattgggcagcctggcgggcatcaccaccctgcatcagaagcgcgtggaacaggccggtttcgcggtgctcaagtcccccgatgtgccctcgatcctggtggagacgggcttcatctccaacagccgcgacagccagcgcctggtcaccgcgcggcaccagcaggcgattgccgatgggctattcgcgggcttgcagagctacttccagaagaacccgccggtgaacagctacatggcctggttgcaggaacagaaaaaagcccaggcctgacgcggcccaggcttcttccgtaggagcacaacttgcgtgcgatgaagacgctgcggtgtatcagctataccgcgtaagcgtccatcgcgggcaagcctcgtttctacaaaatactctgctcagcagccgctgatccggctgcaagtgaacttgccgctgctgcggccggagctggaaaaacggttgcgggtggtccagccgacgcgctggctatagccgacccaggcctcgccgtcggaggccaggccggtaaagaaggtcagctggccgtaacggctgttggtctgcgcccaataacgtttgccggcgacctcgaaaccccgcagataagtagtactgcccgcggccgcgacgctgtaggcgttgccttcggcatccacgcaggccagcaggttggcgctgcgggtgcaggtggccagggcgcttgggacttgcgcgatggcggtgtccgcgaccagcagggacaggctcagcagcgtgtatttcaaggcgtggcgcatggggtttctcggctggggacgctcaagcatcccgcccttcgtcgcgggcggcaagagagggttggcttatttgtattgttatactataacattaaataaagcctgatccgtgacccaccatgactgaacgcccgatgaccgaagcgcaacttctcgcccagcccgaggcggactacatgaacgacgtccagcaggcctatttccgtgagctgctgctggcccagcgcgtcgagctgcaagagcgcatcgacggtgagttcgaggtgttgcgcgagcaggaaccccacagcgaccccgccgatatcggcagcgccgaagagcagcgtcagtggcaactgcgcctgctggagcgggaaaagaagctgctggacaagatcgacgaagccctcgaacgcctggcccgtggcgagtacggctggtgccgcgaaaccggcgaggccattggcctcaggcgcctgctgctgcggcccaccgccaccctgtgtatcgaagccaaagaacgccaagagctgcgcgaacgccatcaacgggcgatctgacccagccacccagcccccgatgaggatcacctgatgaccgaccgtcttcccgttaccgtgctgtccggctttctcggcgccggcaaaagcacgctgctcaactacgttctgcgcaaccgcgacaacctgcgggtggcggtgatcgtcaacgacatgagcgaaatcaacatcgacggcagcgaagtgcagcgcgatgtcagcctcaaccgcgctgaagaaaaactggtcgaaatgagcaacggctgtatctgctgcaccctgcgcgaagacctgctggaagaggtcggcaaactggccagggacgggcgtttcgattacctgctgatcgaatccaccggcatctccgagccgctgccggtggccgagaccttcacctttcgcgacgaagcagggcagagcctggccgacatcgcacgcctggacaccatggtcaccgtggtcgacggcatgaacttcctgctcgattaccaggccgcggaaagcctggcgtcccgcggcgaaaccctgggcgaggaggacgagcgctcgatcaccgatctgttgatcgagcagatcgagttcgccgacgtgatcctgatcagcaagatcgacctgatcggcagcgatgagcgtcaggaactgatcgccatccttgagcgcctcaattcccaggcggaaatcatccccatggtgatgggcgaagtgccgctggcgaagatcctcaacaccggtcgcttcgacttcgagcgcgctgcccaggcgccgggctggttgcaggagctgcgcggcgagcacgtgccggaaaccgaagaatacggcatcgcctccagcgcctatcgggcgcggcgacctttccatccacagcgctttttcgatttcatcaaccgcccctggagcaacggcaaactgctgcgttccaagggctttttctggctcgccagcaagcaccaggaggctggcagctggtctcaggctggcggtctgatgcgtcatggtttcgccggacgctggtggcgtttcgtgccgaagcagcactggccgcaggatgcggaaagcaccgcggcgatcatgcagaactggaccgccgccaccggcgactgccgccaggaactggtgttcatcggccagaacatcgacttcgcccggcttaccgccgagctcgacgattgcctgctgacggacgatgaaatggccctgggcgcggagggctggcgcctgatgcgcgacccgttcggcccctggcatgaagaggccgccgcctgatgctctaccaaccactgtcccctgtgggagcgaacctgcttgcgaagccgctcctgcggccaaccctgcacaaaccgatacgccgcgaggcttgcggcccggcccctatcgtcctggccgaggcgctggacgatgaggtcaacctggccctgtggcagcgccagttgccggcgcatatcgccgatttcggcgccttgctgctgtcgctgaacgagccgctggccgagtcgctgtcgctggaattcgacacggaggacgcggagccgaacctgcgcggcctggcttctggcttcagcgatctgcaggcctacgatggctttatcgccgatgtcgcctggctggtcagcgcctttgcctgcctgctgggcgccaagcgcgtcggtctgcgcctgcgggtgctggataaggccatgtgcccgcgctttcatgtcgaccatgtgccggtgcggctgatcactacctatgccggcgccggcagccaatggttgcgcgagggcgcgatggatcgccggcaactgggccaggccgaggccgaacctacggatgccgcgctgatccagcagatggccagcggcgaggtggccctgttcaagggcgagaaatggctgggcaacgagggtttcggcctgatccaccgctcgccgcaaccagcccccggcgagcgccggctgatcctcaccctggactggctcggctgaccctgtagccgctgccgcaggctgcgatcggctccgtaggagacgtgctcttgaggccctcggaaggcgctgcgcgccttatcgcagcctgcggcagcggctacgggaatttcgctgccgcggcttagcgcgtaggatcaatcacctcttttccgagcgttcccccatgctgcacaacatccccacccacgtcatcgccggccccctcggtgcgggcaagaccagcctgatccagcacctgttggcacagcgtccggccaatgagcgctgggcggtgctgatcaacgagttcggccagatcggcctggacgcggcgctgctggcccgggacgaggacggtatcgccttgggcgaggtggccggcggctgcctgtgctgtgtcaacggtgcgccgttccaggtgggcctggggcgcctgctgcgcaaggcccggcccgaccgcctgtttatcgagccttccggcctggggcacccggcgcaactgctccagcaattgcgcgaggcgccctggcaaaaggtcctggctgtgcaaccttgcgtgctggtcctcgatgcccaggcattggcggccggcaagccgctgccgcaggcccaacaggaagcactgcccagcgccggcctgttgctgctgaacaaggacgaagggctcgacgcggcgcagcgtcagggcattctcgagcagttgccggcctgtccgctgctctggactacccgcgggaccttggcgctggagcgcttgcctggcgtggaggctcgcgcgggggctgccatcgaggccttcgaagtacccaagggattggcacagctgccggcgatctggaccgatccggcccagcccatctgcctgagtcaggcccaggagggcggctggagcatcggttggcgctggcacccgagccgggtgttcgatgttcggtgcctcgagcaatggctggcgagcctcgactggcgccgggccaagctggtgatccatggcgccgatggctgggtctcgggcaacgccctggataacgccgagcagcactggcaagccagcgaatggcgccgcgattcgcgtatcgagctgatcttcagcgagccgcaggacgtggccaccctgcagcagtctttggccaagtgctgccaatagcccaacccggtccgatgcttctgtaggagcgaaaaaattgtcaacgatgacgcgttttgccaggaaaaatcgccgcttcgcggctatcgcgagcaagcttcgttcctacaggtgatccaggcgctccggtgctacttgctgcgcccttcgcgccattggctcagttcgatcacttcggcgctgtgtgtcggcacgggtggcggcgcgggcgttgcaatcgggtagggcgccagctcgatctgcgcgctgtgggcgccgaactgggtgatggtccccgcatggcgggtttcgccggtgacggtgaattcgaaggtgtagatccgggccaggcgccggcgaccactggcgtccctgacgaaaccgatgcgcttcaacgccacgttgccgtccagcagctcgatatcgagtcgtgcgcaatgctgcttgaccctctccagcgcccgctcgcgcaggccgtggttgtgccatagccaggcggcgccggtcgccagcagcatcagcacgaaaatgtttccaagggtcagcatgaggtgcgctccaacgaagtcgcaccagcttaactgcgtcttcggtctgtcgtacaggttgtgtttagtcgcatactgcgcggctcgaatttcaatcgttttacggaatgacccgaatgaaacgtacgcctcatctgctcgcgatccagtcccatgtggtcttcggccatgccggcaacagcgccgcggtgtttcccatgcagcgggtcggggtgaatgtctggccgctcaatacggtgcagttctccaaccacacgcaatacggccagtgggccggcgaggtgctgtcgccgcaccagatcccggagctggtggaaggcattgccgccatcggcgagctgggcaactgcgacgcggtgctgtccggttacctgggcagcgcggcgcaggggcgggcgatcctcggtggcgtggcgcggatcaaggcgaccaaccccaaggccctgtacctgtgcgacccggtgatgggccacccggaaaagggttgcagcgtgccccaggaggtcagcgacttcctgttggaagaggcggcgaccgtggcggatttcctctgccccaaccagctggaactggacagcttcgccgggcgcaagccgcagtcgctgttcgactgcctggccatggcccgggcgctgctggcgcgtggcccgaaagcggtgctggtcaagcatctggattatccgggcaagctgccggacggcttcgagatgttgctggtgaccgccgaaggcagctggcacctgcgtcgtccgctgctggcattcccgcgtcagccggtgggagtgggcgacctgacttcgggcctgttcctggcccgggtgctgctgggcgacagcctggtggcggcgttcgagttcaccgccgcggcggtgcatgaagtgctgctggaaacccaggcctgcgccagttacgaactgcaactaatccgggcccaggaccggatcacccatccacgggtgcggttcgaggcggtgccgatcgagctgtaacgggttgcggggggggcttatcgccaacaggctcgctcggtagcagcgagcctgtctcggacgatcaggcgtcggccttgatttcctgatagcgcttttccagctcctggcggatctgccggcgttgctgggcctgcatgaagcggcgcttgtcttcgctggtttgcggttgcagtggcggcacggcggcgggtttgcgctggtcgtccacggccaccatggtgaagaagcaactgttggtgtggcgcaccgagcgctcgcggatgttctcggtgaccaccttgataccgacctccatcgaggtgttgccggtgtagttgaccgaggccaggaaggtcaccagttcgccgacgtggatcggctcgcggaagatcacctggtccaccgacagggtcaccacataacggccggcataacggctggcgcaggcgtaggcgacttcatcgaggtacttgagcagggtgccgccgtggacattgcctgagaagttggccatgtcaggggtcatcaataccgtcatcgacagctgggcgtttccgggttccatagcacactcacgggttaaggcaggggttgcggggcgcacctctgcgggtgcttggtcagcgtttcaaaccatcgataacgggacgctgcgcccgcggtcgccgtcacgcggcgatctatctgtttccatatattgcaccgcctttctggcacaagtcgcgatgttaaccttcaaaagcccgtcccaagggcttttcccgctggccggccggctgcgcaacgcccccgcgccgcccgcaagaacacgaccccaaggagccccacgccatgcatgccatcagctttattcaggacctggcagtgatcatgctggtcgcgggcgtggtgaccattctcttccaccggctcaagcagccggtggtcctcggctatatcgtcgccggcttcatcatcggcccgcacaccccgccgttcggcctgatccacgacgaagacacgatcaagaccctggccgagctgggggtgattttcctgatgttctgcctgggcctggagttcagcctgcgcaagctgttcaaggtcggcgccacggcctttatcgcggcgttcatggaaatcgtgctgatgatctggatcggctacgagatcggccgctggttcggctggaacaccatggactcgctgttcctcggcgcgatcctggcgatttcctcgaccaccatcatcgtcaaggcgctcaacgacctgaagatgaagaaccagcgcttcgcccagctgatcttcggcgtgctgatcgtcgaagacatcctcggcatcggcatcatcgccttgctctcgagcatcgcggtcagcggcaccgtcagctccggggaagtgttctccaccgtcggcaagctctcgctgttcatgatcgtcgccctggtcatcggtatcctgctggtcccgcgattgctggcctacgtggccaggttcgaaagcaacgagatgctgctgattaccgtgctggggctgtgttttggcttctgcctgctggtggtcaagctggagtacagcatggtgctcggcgccttcctgattggcgcgatcatggccgagtcgcggcaattgctgaagatcgagcgcctgatcgagccggttcgcgacatgttcagcgccatcttcttcgtcgccatcggcctgatgatcgacccgcagatcctcctgcaatacgcctggccgatcgcggtgatcaccgtcgccgtggtgctgggcaagatgctgtcctgcggcctgggcgcctttatcgccggcaacgatggccgcacctcgctgcgggtcggcatgggcctgtcacagatcggcgagttctccttcatcatcgcggcgctgggcatgaccctgcaggtcaccagcgactttctctacccggtggcggtcgccgtgtcggccattaccaccttgctcacgccttacctgatccgcgccgccgacccgctgtcgctgaagctcgccgccgtgatgccgacccgcctgagccgggtgctgggcatgtacggcgaatggctgcgcagtatccagccccatggcgagggggcgctgctggcgtcgatgatccggcggatcctgttgcaggtcggggtcaatctggcgctggtggtggcgatcttcttctccggcggttatttcgccgcgcgcatcggcgaatacctgcaggactggatcagtgatccgagctggcagaaggcgctgatctggggcggggcgctgctgctgtcgctgccgttcctgatcgccgcctatcgcaagctcaaggccctgtcgatgctgctggcggagatgggggttaaaccggaaatggccgggcgtcacacccagcgcgtgcgccgggtgatcgccgaggtgattccggtgctgtcattgctggtgatcttcctgctgctggcggcgctgtcttcgagcatcctgccgaccaccgagctgctggtgctgatcgcggtggtgacggcggcggtggccgcgctgctgtggcgctggttcatccgcgtgcacacccgcatgcaggtggccttgctggataccctggataaccacaaggaagacaatgggcactaattgcccggtgatacacaactcaagggctggtcgcgccagtgtcgccaggcttcgacccagccctggtcgtgggtgaccccgggcaggctgacggattgtacgcagaaggcttgcgtccccagtgcctgccgataggcggggtagaggctggcaggcacgctgcggtcggcctggccgagcaaatgccgttgcgccaccagggccagcttgggtgcctggtccagcggctcgagggagccgtgcaacgggctcagccccagcgcactgacccatagccgaggactcagattgccggccagggtttgcacctgggcaatgtcgtctcgccgcgcggccagcaacagggccagtgccgcgccaccggaatagccgatcagctcgaaatcctgattgccataacgctgcttgaggcggtcgagggcctggtcgaggccgcgcagtaccgctggggaaaagcgctggtcggtccagatcgccgccgtacagtcggccgcgctgacgaattggcaggggcgggccagatagacgctgggacgcggatcgctcagcgccagttgcaccatcagcaggtgctgcgggctggggtcgaggctgggttggcgggctgtcgcccaggcctggccgtcgccttcaaggtagacgcgcaggcggggttgtttgggtaagcgcaggggcaggctgctggcgagcgggaagggtgacgtgggcaggacttcgacctgatgggcgtactgcgtgctcaggctttgcaactgagccatgggcgactgacaacccgccagcaggctgctggcgagtagtgtcaatgcggcgatcgaccgggtggcgcgaccgcttgtgaacgtcatgcaacgggtggcagtcgatccatgcgcctgcgcccgcggggcgaaaccgcgcaaggccgatcagctttccagccagacgtcccgcgcccagtgccacaccgattcccaggattcttcggtgatcagctcttcttcgccggaccacagcaccacggtgccgtcttcctcgacgcagtagtagtcgtcaccgtcctggcagatcgggatcagctcgcgcggcacgcccatgtcccaggcggtggcggccacttccggcaggtaggtgtgggattgcgggtcggtcacggtgaccggctccaggctgccgtagacgacatcgctcacggtcaacaggaactctttgaagacgaaggggatattgatgaacagctgttcttcgatttccaccagcaggtcttcatccggcagttccaggggaacgggtaccggttcgtttgcttcacggagttgctcgatgacttcttccacggcctgggtcctcttagctctatggcgcggtttaatagacggcggtttatacagtagctcgctataagtgcaatcgtgaaatgcaaaaccccgacctgagccggggttttgcgattaccgatgtgacactggagagaatcagccgttctggcggatacctgcaaccagccaaggctggttttcgccctgggcgcgctccatgttccagctttcgctgaacacttcgccctggtcgaaacgcgaggtcttcgacacgccggtgaaggtcagggtcgcgatggtcttgtcggcgcggtcgtcgacgccttcgagttgcacattgaggttgtcgatgtaggtcgactggaagccgtcgcccagatcggcacgttcctgcttcaggaattgcagcatctgcggggtcacgaactcagcgatcttgtccatttcgttggcgtcccagtgttgctgcagggactggaagtggttgcgcgcggcttcgacgaaacgctcttcgttgaaccaggccggcgcgttgattaccggacgggccgcggcggcaggtgcagccgaaccaccgaagatcgaaccggaggcaggttttggctcgaaggcttcacgctgcatcggtgcgtggccggctggagcgtactgctcctgctgcttgcgacgacgggcggcgataaagcggaagaccaggaaggcgatgaccgccatgatcaggatgtcgaagatctgcatgccctggaagccgtcgcccatgaacatggaggccagcaggccgcccgcggcgataccggcgagagggccgagccagcgcgaggcgccgctggccttggtggcagcgcccgcggcaccggcagcgccggcggtcgcggcagtggaacccatgccggaagaggacggagccatctggctggtctggtgggtcggcgcggcgccagcgcttttgccgccaccgaagcgcttggcgttggcgtcgaggctcatcgtcaggccgatgcacaacgccatggcgatgctaagaaaacgtttcataaagggaattcccatttgtggatggcacgcgcgccatgttgcacaggtgaagtgtcactggctagcggcagagtgtttcgggcttttgcctgacagccgcggttcagcttgggtcgaggcaagtgggccctgtacaggtttgtccgttgggcggatgcaaaggttcagtggcctgtcagcccgacttcgccccatgccgcggggcaaaggaggtcaaggcatcagatggcttcgagcttggcgtagccgagcatcagccacttgctgccttcgctgaagttcacctggacccgggcctgggcgccggcaccttcgaagttgaggatcacgccgtcgccgaataccgagtggcgcaccgcctggccgaggctgaggccggtgtccgggatctcgctgccgccgaacaggctgctggtgctctgcgactggccgccgccgaacggacggctgacgctgttggacaggcgcacttcctggatcagccccttcggtacttcccgtacgaaacgcgacaccttgttgtaggtctcgctcccgtacaggcgtcgggtttcggcgtaggtcatcaccaggttctgcatcgcccgggtgatgccgacgtaggccaggcggcgttcttcttcaaggcggccgggttcttccaggctcatcttgtgcgggaacaggccttcttccatgcccaccaggaacacgtaagggaattccaggcccttggcgctgtgcagggtcatcagctggatgctgtcttcgtgctcgtcggcctgggtgtcgccggcttccagcgaagcgtggccgaggaaggccgccagcggcgtcagttcctggtcttcttcggtatgttcgaagttgcgcgcggcgctgaccagttcctcgaggttttctacccgggcctggcctttctcgcctttttccgcttcgtggtaggcgatcaggccggattgctcgatgacggtctgggtcatcaggtgcaacggcatctcggcggtcacggtcgccaggtgctcgatcaactccatgaaggcgcccagggcgccggcggcgcgcccggtcacacctttattggccaccagctggcgcatcgcttcccacatcgacacatggctgtgacgcgcgtgttcgcgaatcgcttcgacggtcttttcgccaatgccgcgggtcggcacgttgatcacccgctccagggccgcgtcgttgccgcgaccttccagcaggcgcatgtaggccatggcgttcttgatttcggcgcgttcgaagaagcgctggccgccgtagatgcggtacggaatgcgctcgcgcagcaaggcctcttccagcacccgcgactgggcgttggagcgatagaggatggcgatatcgctgcgggccaggccggtcttcagggcgctttcgatggtttccaccacgtagcgcgcttcatcgtgttcgttgaaggcggcatacaggttgatcgcttcgccttcgccgccgtcggtccacagctccttgcccaggcgcccggtgttattggcgatcagggcgttggcggccttgaggatgccggcggtggagcggtagttctgctccaggcggatcacttcggtgtccgggaagtcttcggagtactggtggatgttctcgatcttcgcgccgcgccagccgtagatcgactggtcgtcgtcgcccaccaccatcaggctgtcaccgcccttggccagcaggcgcaaccaggcgtactgcacggcgttggtgtcctggaattcgtccaccagcacgtggcggaaacgcttctggtagtgcgccagcaggcccgggtggtcgcgccacaggtccagggcacgcagcagcagctcggagaagtcgatgaccccggcgcgctggcaggcggcctcgtaggcttcgtagatgccgcgcatggtggccaggaacaggtcgccgctggcttgaatgtgttgcgggcgcaggccttcgtccttctgcccgttgatgaaccactgggcctgccgggccggccagcgctgctcgtccaggccgaggtcgcggatcacccgcttgaccaggcgttgctggtcgtcgctgtcgaggatctggaaggtctggctcaggccggcctcttgccagtgcgcccgcagcaggcggtgcgccaggccgtggaaggtaccgacccacatgccggccgggttgatacccatcaactgctcgatgcgctggcgcatctcggcagcggccttgttggtgaaggtcaccgacaggatggagtggggcgaggcgttctcgacctggatcaaccaggcgatacggtgcaccagcactcgggttttaccggagccagcaccggccaggaccaactgacgacccaaggaggcggctacggcctggcgttgggcatcgttgagggagttcagcagaagggagagatcatcgcgcatcggggcattctagggggctggcgcacaccgggcaaaccaagctttggtttagccgataaaagaacgccggggacgaccggtcggtcacgggctgcagccgttggccgggcttggctggaggaatttcgcagggatcggcgctcgcgcggatttgccgattttatgattccaggcagtttggtccgggcggttgcttgtgtatgctccggcgacgtttcgggctcaatcattataagaacactgcctatgacactcagcactggcccgtccggacccttcgtggagcctcgggttattcgcaagcaatacgccatggagatggcggtagagcgcacgcgcctgctttatcagggttccctgttgcccaccctgttcatgctgctcaacggcctggtctgcgcctggctgctgtggagccccgagcgttattggctggtcagcgtgtggatggtctggttgctggccctggtcgccctgcgggtgatccaggtggcggcgttcgactcggcgattcccagtcgccaggcgcagccggtctggcgccgcatgttcctgctcggctccgccgtcagcggcctgaccctggcctgtgccggcatcgccctgatgcccaccgacaatttcctgcatcaggcctgggtcttcggcctgatcggcgcggcgatcctctcggccagcgtggcctacgcggtcagcctgccggctttcctgtcctttaccttgccctgtttgctaccggcgatcggctacctgttctggggcggcgacgagcagcagcgtggctggggctggctgggattgatcctgctggtgtcgctgagcgtggtggcctggcaggtcaaccgtctgatccagatgggtttgctgcggcgtttccagaaccaggccctgatcgaacatctgcaacaggcgcagagccgtagcgaacagctcaatagcgagctgctgcgggaaatcgagcagcgccgctgcgccgaagagcaattgcgcgaggcccaggtcgacctggaaagccgggtggtccagcgcagcctcgagctggacgcggccaaccaggccctgagcaagagcgaagcgcgcctggccctggccctcaaggccagccagctggggctgtgggactggaacctgcagaccgacgaggtccatcacagccatatcaaggaactgttcggcctggagccggagttcgtgcgggcgatgctcagccacctcaagccgctgctgcaccccgaggacctgccgctgctcaagcgcgcgctggtggagcacctgaaggggcgcaccgaggattacctggtggaatatcgcgtgcggcatgccgatggccgctgggtctggatcgaggaccgtggccgcgccgtggagcgcggcccaggcgggcgggtgctgcgcatggtcggcacccggcgcgatatcagcgccagcaagcaacaggaagagcagcgccgcctggcggcgatggtgttcgaggcggccagcgagggcatcgtcatcctcgaccccgattacgtgctgctggcggtcaatcaggcgttcagccgggttaccggttaccagatcgaggacatgctcgggcgcaatgtggtcgacctgccgtgcagccgcgacgcacggcggcactttccggtgattcatcaagccctcgaacagcacggcagctggcagggcgaactggtggaggcgcgcaagaacggcgagctgtacccgcagtggctgcaattgaacgtggtgcgcgatacgcggggaaaggtcagccatattgtgggcttcttcgccgatctgtcggcgcggcgcgaatccgaagagcgcatgcgctacctgacccactacgacgaactcaccggcctggccaaccgttcgctgtttcgcgaacgcttgcgcgaagcccatcaacggatgcgccagggcggccgcagcctggccctggtgcatatcaacctggaccgtttcaagctgctcaacgacagcctgggccacgacatcgccgaccagctgttgcagaaaatggcacggcggctggtcaacgcgctgccggaagccgacaccattgcccgcttgtccggcgatgagttcgcggtgctgttcgatgcctacggcagcctgtcgagcctgacccgggtggccacccgcttgtcggcgaagctgcgcctgccgatcaccgtggaaggccacgagctggtggtcagcgcttccatgggcatcagcatgctgcccgacagcgcgcgggaaattccggcgctgatcagccagtcgaacatcgccatgcaacacgccaagcacctgggcggcaacaacttccagttctacaccgccagcctgcaagccagcaccctggagcgcctgcagctggagaaccagctgcgcaaggcggtcgaggagcgacaactgaaggtgttctaccagccgaaactgtgcctcgccaccggccgcctgaacgccgccgaagccctggtgcgctgggaccatcccgacctgggtcgggtaccgccgggagactttatcggcctggcggaagagatcgggctgatcggcccgatcggcgaattcgtattgcgccaggcctgctggcaagcctgcgagtggcagcgccaggggctgccggcgattcgggtatcggtgaacctgtcggtgcatcaactgcgccagggcaagctggtcagccaggtgcgcagcgtgctggaagagaccgggctggcgccgcatttcctcgagctggagctgaccgaaagccatctgctcgacagcgtcgaacacatcgtttccaccttccagcaactgcgcgacctgggggtgaagctggccatcgacgacttcggcaccggttattcctcgctgagctacctcaagcggattccggtggactacgtgaagatcgaccaggcgttcatccgcggcctgagcgaaggcggcgccgacgcggcgatcacccgggcgatcatcgccatggcccacgggctgtcgctgaaggtggtggccgaaggggtggagtatccggggcagctggcatttctcaaggagcagaaatgcgatgaggtgcagggctacctgatcagccggccggtggaagccgagggcctggcggcgctgttgcgggccgagaccctgtagccgctgccgcaggctgcgatcggctgcgcagcggccgcaaaaggccaggaatatctgaagtttttacgaataccgggtcgggggcggctgcccggcgccagcagctacaaagagcaggcaaggctaaaacagtggggcgcaaaggtgattcagttacgcattgagcaggcaaaaagcgaattcatgtagtataactacaaaattgctacatccttgggcgtctgccccataacaatgagtccagccctttgaatctgttgcagcacattgcccaatcacgccatctcttgcgcaagtcggagctcaaggtcgccgatcatgtgctgctcgaccctgcggctgtgatgcacagttccatggccgacctggcccacagcgtgggtatcagcgagccgaccatcgtgcgcttctgccgcgccatcggttgctcggggttccaggacctgaagctcaagctggcccagagcctggccgccggggcgagcttcggccagttcgcgattcatgaagacgactcggtcgccgactacagcctgaaaatcttcgacaccaccctgcacaccctgatggaggttcgcgagaagctcgatccggtggagttgcaacgggctgtgaccctcatgtcccaggctcagcgcgtggagttctacggttttggcgcttccggcgcggtggcggcggatgcccagcacaaattcttccgcctgctgctgaccgcggcggcctattccgacccgcatatgcaggcgatgtcggcggtgaccctcaagcccaccgacgtggcgatctgcatttcccagtccgggcgttccaaggacctgctgatcaccgccaacctggtgcgtgaaagcggcgcctcgctgattaccctgtgcccgagccagacgccgctggccgagctgtcgacggtcaacctggcgatcgatgtgcacgaagacaccgagatctacaccccgctgacctcgcgtattgcccacctggtggtgatcgacgtgctggcgatgggcgtggccatggcccgcggcccgagcctggtcaaccacctcaagagcgtcaagcgcagccttcgcagcctgcgcctgtcgcccaagtcggtaaaagccctggacgattgaacgctgcgcctcatcgccgagcgtccccctgtaggagcgagcttgctcgcgaataatcgtcaatgatgatgcggtgtagcggaatgaaccgccgcttcgcggctatcgcgagcaagctcgctcctacaagggaggcgggcgccatacggcagctttcatcgtcctgtcatggacccgccgccaaaccgtaacgcccgacgtccatcttgaagctcccgtactcgcattgggagactcgaaatggcccggccttacgaagagagcagcagcgcagtcaagacccgtcgtcaacaggaagaccagcgccgcatggaatttcgccgcgcgatcgaacatcgctgtgagctgcgccgtctgcagcaggaaatcaatgactaccccgagctggacgccgtcaattactggcaggcagcctcggcagcttcccgtcaaaacgttcaacaagcccgctgatctgtactcgttcgctgcggataaaccccaggaacgcatgcgctaccggtgacaggcgttttgccttggcctgcaccaggcaccagctgcgatacaacggcagctcttcgaccggtaactcgacgagtcccccggtcgccaactcaaggttcagggcgtggcgcgtcaacagcgccacgcccagacccgccagcacacactcgcgctgagcctcggccgacgatacttccagggtctgggtgaagtgcacgcgtttttccttgaaatactcctcgcaggccaggcgcgtgcccgaaccctgttcgcgcaccagcaggttgtagggttccaggtcctgcaggcgcagcggcccgaggtggcacagcggatggtcgggcggcgccacggcgacgatcgggttattgaggaacggcaggaattccaggcccatgtcctgcgggaccatggacatgatcaccagatcatcgcggttgtccgagaggcggcggatcacctggccccgattgaccaccgtcagttgcaggttgacctccgggtgctggcgcttgaaggcggcgaacaggtgcggcacgaagtacttggcgctggattccaccgccagtttcagctggccctgcaaggagccctgcatgtccgacagttgcatgtcgaggttttccaggcgcccgaagatgtcgcggctggcccgttgcagcgcctcggcggcctcggtcatgtagagcttcttgccgacgtaatcgaacaggggctggccgatcagctcctccagctggcgaatctgcaggctgacggcgggttgggtcagggacatttcgtcggccgctcgactgtaggagcgcagatcgcagacctcattgaaaatctgcaattggcgtaatgtcatacgcatcaaggacttacgcattatctaaggtctcgcgccgagggctgtcggatcaactataagtctttgcttatgagcgacccaataattattgatttttgttaattcatcgacaggaatagtgtgggcctgcgactggcttgaaacatttggtcacgcgccgacccggtctagcgggtcttttgttccaacggctcaagggtacctccaagtgataaaaaagatcctgatcgccaaccgtggtgagattgccgtacgaatcgtgcgtgcctgcgccgagatgggcattcgctcggtcgcgatcttctccgacgccgatcgccatgccctgcatgtgaagcgcgcggatgaagcccacagcatcggtgccgaacccctggccggctacctgaacccgcgcaagctggtgaacctggccgtggaaaccggctgcgacgcgctgcaccccggctacggcttcctttcggaaaacgccgagctggcggagatctgcgccgaacgtgggatcaaattcatcggcccctcggctgaagtgattcgccgcatgggcgacaagaccgaagcccgccgcagcatgatcaaggcgggcgtgccggtcacccccggcaccgaaggcaacgtcgccgatatccatgaagccctgagcgaaggcgaccgcatcggttacccggtgatgctcaaggccacttccggcggtggcggccgcggcattcgccgctgcaacagccgcgacgaactggagcaggcgttcccgcgggtgatttccgaggcgaccaaggcgttcggttccgccgaagtgttcctggaaaagtgcatcgtcaatcccaagcacatcgaggcgcagatactcggcgacagcttcggtaacgtggtgcacctgttcgagcgcgactgctcgatccagcgccgcaaccagaagctgatcgagatcgcccccagcccgcaactgactccggaacagcgcgcctacatcggcgacctgtcggtgcgcgcggccaaggccgtgggctacgagaacgccggtaccgtggagttcctgctcgccgacggcgaggtgtacttcatggagatgaacacccgggtgcaggtggaacacaccatcaccgaagaaatcaccggcatcgacatcgttcgcgagcagatccgcatcgcttccggcctgccgctgtcggtgaagcaggaagacatccaccaccgtggtttcgccctgcagttccggatcaacgccgaagacccgaagaacaacttcctgccgagcttcggcaagatcacccgttactacgcgcccggcggccccggcgtgcggaccgacacggcgatctacaccggctacaccattccgccgttctacgattccatgtgcctgaagctggtggtctgggccctgacctgggaagaggcgatggaccgtggcttgcgcgccctggacgacatgcgtctgcaaggggtcaagaccactgccgcctattaccaggaaatcctgcgtaacccggaattccgtagcggccagttcaacaccagttttgtggaaagccaccctgagctgaccaactactcgatcaagcgcaaacccgaagagctggccctggccatcgccgccgccatcgccgcccacgcaggcctgtgaggaaaagaacaatgagcaagaagatttttgttaccgacaccatcctgcgcgacgcccaccaatcgctgctggcgacccgcatgcgcaccgaagacatgctgccgatctgcgacaagctcgacaaagtcggctactggtcgctggaagtctggggcggcgcgaccttcgacgcctgcgtgcgcttcctcaaggaagacccgtgggagcgtctgcgcaaactgcgcgccgcgctgcccaacacccgcctgcaaatgctcctgcgtgggcagaacctgctgggctaccgccattacagcgacgacgtggtcaaggccttcgtcgccaaggcggcggtcaacggcatcgacgtgttccgcatcttcgacgccatgaacgacgtgcgtaacctgcgggtggccatcgaagcggtgaaagccgccggcaagcacgcccagggcaccattgcctacaccaccagcccggtgcacaccatcgaggcgttcgtggcccaggccaagcagatggaatccatgggttgcgactcggtggcgatcaaggacatggccggcctgctgaccccttacgccactggcgaactggtcaaagcgctgaaggccgagcaatcgctgccggtgttcgtccactcccacgacacggccggcctggccgcgatgtgccagctcaaggctatcgagaacggcgccgaccatatcgacaccgcgatctccagcttcgcctggggcaccagccacccgggcaccgagtcgatggtcgccgcccttaaaggcagcgaattcgacaccggcctggacctggaactgctgcaggagatcggcctgtacttctatgccgtgcgcaagaagtaccaccagttcgaaagcgagttcaccgcagtcgatacccgggtgcaggtcaaccaggtgccgggcgggatgatttccaacctggccaaccagctcaaggagcagggcgccctgaaccgcatgaacgaagtgctggcggagatcccgcgggtgcgtcacgacctcggctacccgccgctggtgaccccgacttcgcagatcgtcggcacccaggcgttcttcaacgtgctggccggcgagcgctacaagaccatcaccaacgaagtgaagctgtacctgcaaggcggctacggcaaggcaccgggcgaggtggacgagaagctgcggcgccaggccatcggcagcgaagaagtgatcgacgtgcgcccggccgacctgctgaagccggaaatgaccaagctgcgcaatgacatcggcgccctggccaaatccgaagaagacgtgctgacctacgccatgttcccggacatcgggcgcaagttcctcgaagaacgcgaagccggcaccctgaccccggaagtgctgttgccgattccggaggcgggcggcgtgagctcggccggcggcgaaggcgtaccgaccgagttcgtcatcgacgtgcacggcgagacctaccgtgtcgacatcaccggcgtcggcgtgaaggccgaaggcaagcgccacttctacctgtccatcgacggcatgccggaagaagtggtgttcgagccgctcaacgagttcgtcggcggtggcagcagcaagcgcaagcaggccagcgcgccgggccacgtcagcactaccatgccgggcaacatcgtcgacgtgctggtcaaggaaggcgacaccgtcaaggccggccaggcagtgctgatcaccgaagccatgaagatggaaaccgaagtccaggcggccatcgccggcaaggtcaccgccatccacgtggccaagggcgaccgggtcaacccgggcgaaatcctgatcgagatcgaaggctgagttcaggccttcatctgcaacgttttacctcgggggggcacatgctccccttttttttggttcttcacggattaccgggaaagacgctcttgatcttcatgaaaaagaattcgctgtcccggtaaccgtacgccatccgcttgatgaccttgattcgattgttgatgccttccaactggcccgtatgcattggccagcgcacccggctgacgatgccccgccagtaacccttcagtcgtttggcaaactggatcagaggcggtatgtcgctttcatgcgcatggcgcagccattgtcgccaggctgatcgccagccccaggcggtgctcggtgtccaaagcgttttgagttcagccttcatcaaatagaccgtcatcaacgcttggttggccgccagcagatcctccaggcggacttgttgttccggcgttttcaggttctgccgattgcgcagcaacagccatcgcgcctgcttgatgaccgtgcgggcaggcttgtcgtgacgtagccgattcgcttcatcgacgcggactcgatcaatcacctctcgaccatacttggccaccacatggaagaggtcgtagaccacgcgcgcttttgggcagtgctgacgaacctccaggtcaaaggcagtgttcatgtccatcgccaccgcttcgatgcgagcgcaaccctctgaccccagctcttcgaaaaagggtctgactgccgcccggctgcggccttcgccaatccacagcactcgccgggtatcggcgtccagcactacgctggcgtaacgatgacctttgaacagggcaaattcgtccatgaccaagcgctgtggctgcgcctttggcaaaacactcaatgccgcttgcaaggcgcgacgttccagcaagcgaacgctgtcccaatgcaacccgaacagttgggccacgtgtagcgtgggaaggcgctcgcaggcctgaatgaccgcatcggccaggcggcgcgtcatgcgggcatagcgatccagccaactgacggcctccatgcgtttgccacagtcccgacagccgacacgccgaagcaaaacgctgaggcgcactgctcggccaagaatgggcagatcgcggatgactcgctggcagtactcatgcgtggttgaacagagtttttggcagccgccacaggaagggaatcgggtggcgtggggaatcagatcgatctggagcgcgtcaccatcaggcttgatcgtgacgacagaaaagccctcccaaaagggaaggaaagtattaatatcacgcataagaacgccggtttgttagatgtgtttgctcgcacgaacatcatcaatcaaatcggcgttcttgtttctgtgtttcccgggattccgtgaagaaccttttttttgcctgggattttctgatgtctcgcgatcagaaactcatctgccactgccccatccaggcatggttgcggctgttgctccccagttccccgttgtagccgacactcaaggtatggcgcgccgacagtccgacatccaggccagcctcgatcatcaggctgtcgcgatccagggcgctaccttcgaccttgaaagcgctgccgcccagcacgaatgcctggcgggtttcgctgtcgacatccccgtaggtatgacgccagccgagactggcccgtggcgtcaggctgatgccgttttgcagctgattgagttgtgccaggcgcacgccgaaggtgctgctgaagttgtcctgggtctgggagtacacgtccagtgacgccgcgccgcctttctcggtatagcggtcgcggtggtaacgctggtagcccaggttggcgaagggttcgacattgagccggcctgtccccagggtgtaacccagctcggcgaaggcctgttggctgtcggcgtcgtagctgcctttggggcgatcgctgaagcggtcgaactccaccgtgcgcttgttatccccgtcgtgctggctgtacgccgcgcccaggcgcaacgccaacggtccgtcctggcgcatggcataaacccccaggtgccagctgcgaagcttgccgtcgacgtcgctgttgctcaggtcggttttcgagtagccccccagtacgcccatgcgccagaccggtgacaacgaccaatcgatacccagcacgctaccggcggttttctgctgcagcccagggttaccgtgttcgccatcgagcttgccgtagctgccgataccttgcagccagacgcgaccccgggcgttcgggtcattcaggttgcgcaggctgctgggcacgcctgtagccgcgaggggtggggtttgtgcttggtcgagccccaccagcaggccggcgccgctgcccatctggtgcatggcggcgagcatggatgtcgcgacttgcgaactggcgttcagggtcgcgatgcccagattggcattgccgctgccggccagtttttcgatggcgatgcccgcgctgctttcgctggtgttcagcagggcttgatagagcctgttacctggagtcagctgcggctccccagggccgaaaatcggcgtcctatcccaggagtcccattgactggaatcgaggctttccatggctcggaccccgttggtagtccgggcgtagtcggcgaaccggacctcgttgcgggtgaacgtcaagtcgaccctgttcgagctgtaggtaaggatcggggagaggaaggcatagtcatagccgatgacagggtcgaaggttcccgtgatgctgccggcttccagcaccgtgtattggctgtgccagggatacagttgcggcgggtcgacgggatagactcgtagtaatgatcccgtgaggctggcgtttcctgtaaccctggtcgttcccgcactcccatcggcgttgacgttgaagaaccattgggagcgctctcccatcgtcaggtcgccattgacgcgcggtcctccgagttcggcgctggtgtgcagggtgccattgatcgtcagattgcccaccgtgccgctgccgctgtattgggcaccttgatccaccagtacggcgccggtgacgccaaccagattgttcagcctggaaaaagcaaagacgtggaccccttcgttgaagtcgcccttgccggtcagtgtccagtagccctggcgaacttccagggcctggaagttacggctttcgccgaaactgccggagttgtattggtagtcctgctcgttgcccatgatcagcaggttgtggccggtaccgccatccaccaggccttcgaagcggcttttggtccgtaaccgcaaggtgtcgtcgccaccccccatatccagggcaaggccattggtgccactgatcaaaccgtcgttttccacctcgtcagcgaagtcgccgacgaacttcaccccgaacccgtccaggcctcgaatgatgccgtagttatagacctggatggaggagaatgccgagccaccgttgccgtcatcgatcaggatgccgttgttggcaccgctgataaggctgtgcggctctccggtggcgcgtgggaagccggagttgaagatgatgaaaccacctcccgcagagatgccttcgctggtgttggccttgccgtactggttcactccacgggcacctgtcccctggatcgcgccctcgttccagaggcgcacgcttttgccgaccctgacaccgtccccatccacatcgggcagcaagccgctggcaccgccggtgataacgccaccgagttggttacgcacatctgcatcggtgtcgctgaagactcccgctccattgcgaccggtgagtgtgccacgattctcgaccaggccatcctggctgattaccacgccgtgtcgaccaccggatatcaggccacggttgtcgaccaaggcaccttgcgcagtgccaatatcgatgccgtcgaattcgtcgctggcggagcggacatcaccggttgaaatctcgccatagttgaggaaagagctctgattgcctgccttgatgccgtcattgaaggtggagtggatcagtccacccgcgcggttgatcgccaaagctccatccaggaaccatccggcttgtctcaactccaggccctcgccgttgagcgagcgaatcgtgccggagttctcaatgagggcgtagctggcggtgtgatcggtgatgcgaatggcagcatcctccccctggatcaggctgcccgcattgttctgaatatagtatctactcatcgaccagaggggattgtggcttatgtctatcgccaggctacccgtggaaatgatctggccggagttataaatctctcggtcgtgggcttggtaattggggtgcagacccagtgctgttgaactggtgatcagactgcccgtgggggtaaccgtgatcctggtaacgtcctgggtatcggggggcgtggtgaccgagttgtcgatgatgaggctgatggcgtgggcctgcgctgccagactgccggaaatgatcaacgcaatacgcaaggccaaacgatggggcgcaagaatcatggggaagtcccttttctgaagatgccatgtcccgtatgccggtttggcaatacaagagccgacgtttcttactcggcgttttctccaagactagaacctaacagtgaaacctgcgctcaaccgcgctcggcgtaggccttgccgtaatgcctttccatccgcgcctggatcagttccaggccgatcgatagcagccagtagatgatcgccgcggtgctgagcatttcgatgtagcggtagctggagcggccgtaggactgggccaggaacatcacttcccagacgcccatcaccgagatcagcgacgagtccttgagcatcgagatgaactggttggtggccggcgggatgatggtgcgcatggcctggggcagggtcacctgccagaagatcacgctgtcactcatgcccagggccagggccgcctggcgttggccctggggcacgccgaggatgccggcgcggaagatctcgctgaggtaggcgccgtagttcagcgacagggcgatgatccccgcggcaatggcgcccggcaccacgcccagttgcggcaggccgaggtagatcagcaggatctggatcagcagcggcgtgccgcgaaagaacgaggcgtagaagctggcgatgccaaaggccacggcgcttttcgacaaccgggccagcgcggtgacgaagcccagcagcgacgacagcacgatcgagcagaggcagaggaacagggtcagcgccgcgccttgcagaaacccgttgggggccagggtgatgccgagcaggttgggcagcttgtcgaggatgatcgagaacttcaggtcgaagctcaggaagaaactggcgaacaggctgaacagcaccgcccaggtcaggtacaggcgggcacggaaaccgaagaggcgtttgacccgtggcccggccagcgcttgcggtggccggggcggttgcgaaagagaagtcattggctgatgtcggcgccgatccatttctgcgagagcttgctcagggtgccgtcctgcttcagctgggcgaacacttcacggaccttggcatgccactgggcgtcgcctttctcgatggccaccgcgttgggttcggcgtacagcggctcgccggcgagcttgaagcgcgggtcctgggccaggcgcggctgggccgttaccaggttggtgaggatcgcatccagacgcacgccagcgcccaggccgaggtcctggaaggccacgttgtcggtgtcgtacggggcgatctgcacgttgtcgaacgggtactgcaaccgggtgtcctcggcgccctcgatcaccaggttcttgttcaggtagctctcgtagctggacgcgctggtcaggccgatcttcttgtcgctcaggtccttggcaccgtggatacgatcgtccttggcgttgactacgatcaccgccggcgaggcgtagtactgcaccggaaagtcgaagacttcggcgcgggccttgctcggggtcatggagcagatgcagatgtcgtagcgcccgctccagcggccggcggagatcacgtcccaggacggcgtttccaggcgtagcttcacgcccagtttgtcggccacggccttggccacgtcgacgtcgaagccatcgagctggttctgatcgttgaggaaggagaagggcgggtagctttccatcagcacgccgaccaactcttttttctgttcgatacggtccagggtggcgccggcaaaagcctggctggaggcagcgagaatcgtcaggcccagggccagcagcggtttgaatttcattggaatcccgggcagaaaaaaggttgttattaactgaacggtgcgtattaaatagttataagaacgactcagatagtgagttattttcataagcatatgagaaaaaagcatatgggcgcagaaagcagggtaattctggatggcggcatgggtcgtgagctgcaacgccgcggggcgcccttcaggcagcccgagtggtcggcgctggccctgagcgaagcgccgcaggcagtggaagcggtgcatgcggcttatatcgaaagcggtgccaacgtcatcaccagcaacagctacgcggtggtgccgttccacatcggcgaagcgcgttttgccgccgaaggccaggcgctggcggccttggccggcgaactggcgcggcgcgcggtacaggcttccggcaaaccggtgcgggtcgccggttcgttgccgccgctgttcggctcctatcgcccggacctgttcgaggccgatcgcgccgccgagttgctggcgccgctggtcaacggcctggccccgcatgtcgacctgtggttggcggaaacccagagctccacggtcgaggcgcgggcgatccatgccggcctgcccaaggacggcaaacccttctggctatcgttcaccttgcacgatgagaacccagaccaggtgccacgcctgcgttccggcgagccggtggcggacgcggcggcggtggccgcggagctgggggtggaaaccctattgttcaattgcagccagccggaagtgataggcgcggcgatcgacgcggcgcgggcaaccttcgagcggctgggggtgaagatccatatcggcgcctacgccaacgccttcccgccgcaaccgaaagaagccacggccaacgatggcctcgacccgctgcgcgacgacctcgacccgccgggttacttgcaatgggcggccgactggcggcaacgcggcgccagccacctgggcggttgctgcggtatcgggccggagcacattgcggtgctggcgcagcagctggcctaaaccgggcgactcctatatcccgaccacgctcgatgctctatgtagccgctgccgaaggctgcgatcgagcggtacgctcgcggggatcttgcgaccgccggagaccctgcgggtctatcgcaggctgcgccagcggctacaccggcttacccccagcactctgccaaccccttcaactgccccgagccgctctggttgtcctcgctcaaccagcgttcgaacccggcgccgaccttcggccattcggaatcgaggatcgaataccaggcggtatcgcggttctggcccttgaccaccatgtgctggcggaacaccccttcgaagctgaaacccaggcgctcggccgcataacgcgagcgggcgttggcgttgttgcatttccactccaggcggcgataaccgagggcgaaggcttccttggccagcaggtacaccgcttcggtgctcttgggcgagcgttgcatgggcgcgccgaaggtgacgtggccgatctcgatgcggccctgggccgggacgatcgacatcaggctgagcaagccctgcacctggccgctggcccggtcgaccacgctgaagaaatacgggtcgctgttggccgcgtggttgttcagccagtcattgaaggcgctgcgttcggtaaagggaccgtagggcaggtaatcccacagtttggggtcggcgcccgggccctggaaggcacgccacaggtcgtcggcgtggcgcgccgggtcgagtttttccaggcggatgaagcgcccttcgagcagggtggtcgacggcggcggtacgcctttccaatcggcgagtgaggtcggcatgggaatctccttgaacgcttaaagggctttgcgaaattgaatgaaacccgggcgttcggcgatccgctcgtagagctggatggcggtggcgttggtttcgtgggtcagccagtggaccttgcagcagccgtcggccttggcggtggcgtagacgaattcgatcagttggcgaccgacgccggtgccgcgttgctccgggaccaccagcaagtcctgcaggtagcaggagttctcgatgctccagttggagcgatggtagatgaaatgcaccatgcccaccgcctgttcgccgtcccaggccagggccgcgtgggtcggctcggcgggatcaaggaagcgctgccaggtgctgcgggtgaccgcgtcggccagctcggtctcgtagaaacgcaggtaggcctgccacagcggcagccaggctgcgtggtcagcggcggtgacgggacgaatctggatctggctcatggctgctcctggcgcatcagttgggaaatgctctggtcatggggatcggcgctggtggccaacccttcgcgtacgccgtcgatgtcggcggcggtgcggttctggctgagtttgcgcttgccctccaggcgctggatcggcagggcgaagccgacgatggcgcgcagcatgctgtccatgaactcggcgggggcgtcctcgaatttccaggggctggcgcggccggcttcatgctggtcggtcagggcgctgaccacttcgcggatgcgctgcggatcgtggaacacctcggccacgccgtaggcatgcacgctcacgtagttccaggtcggcaccactttgccgtgctcggccttgctcgggtacagcgacgggctgacgtaggcttcggcgccctggaagatcagcagcgcctcggcgccgttggccagttcctgccattgcgggttggccctggccaggtggccgtagagggtgccgtacgggccctggtccggggcgaacgacagcggcaggtggttggcctgcaggccgcgctccccgtaggtcaccagggtggcaaggcgggtttccccgatcagctggtgcagggtgggcaggtcttcttcggcgaaagcgcggggtaggtacatggaaaaatatccttggcgaatggctgcatcctaggcaggctattggtctgttgtaagagccatctttggtcattttcataggtccatttgatcgctctatcccgtcgctcagaggggcaagcccatgaacagcccgacattgccgctttccttcaaccccgccggtatcgagctggaccgcggccaggggctcagccgccagctgtaccaggcgctgcgccagcgggtgctggacggtcggctggccagcggcacgcgcctgccggccagtcgcgacctggcggcggcgctggagatttcccgcaacagcgtggtgcgcgcctacgaccagctgtacgccgaaggttttatcgaagggcgggtgggtgacggcacctatgtggcgcaattgcccgagagccggctgccgatcaaaaaggccacaaaaaatttatccacaaaagtatccacagggttatcaccaggcttacccacagggttatccacaaaatccccgattttacctgggattacatccagtaaagttatccacagcgaggctttgcaaagggtcgaacagcatcatctggcgactccgcaaagcggtccgccacgggcttttcgggtggggattccggccttcgatctgtttccgttcgaggtctgggccaagctgaatgcggctttctggcgcaaaccggatctgggccagctgtgttatggcgattcggccggcgaggagcgcctgcgcggattgatcgcggcctacctgcgcagttcgcgcggtatgcaatgcagcgctgaacaaattgtgatcaccagcggtgcacaacagggcataagcctttgtgcacagttgctggtgaaccctggcgacggcgtggctgtggaaaatcccggctatcgggcggcggggcatgccttcgcgattgccggcgcgcgcctgcacggggtggcggtggataacgagggcttcgactgtgcagccctggcgggtctgagcgattgccggctggcctatgtcacgccgtcccatcagtaccccaccggggtcaccctgagcctggcccggcgcctggaactgctggcctgggccgagcgcagcaatggctggatcgtcgaggacgactatgacggcgagtaccgctacagcggggcgccgctggcacccttggcggcgctcgaccgacaaggccgggtgctgtacgtcggcaccttcggcaaggtcgcgttcccggccttgcgcctgggttacctggtgctgccaccggcgctggtacagcccttcgcccagcgccgggcggtggatgtgcgccattccgaggtcagcacccaggcagtgatggccgaattcatggccgccgggcatttccagcggcatatccggcgcatgcgccgcgccgccttgagccggcgcaatgccttgctggctggttggcctgtggatatccccggggtgggcaaggtgccgaacgtggcggcgggcctgcacctgacgatcccggtggacagcctggcccgggagcgcgaactggtggcgcaggccgcggccgtggatgtggagatcaatggcctgagccactactggctgccggattcgccgctgccgcaggaccggcgcgccgggctggtactgggctttgccgcggtgcccgaagccgctatcgcctgcgccctggagcggctgcgtcgggcctggggcgtgtgatggctatactcgcggccattgtctttatcgagaacccttatgagcctgactctttccgcggcgcccgaacgcaagttcggcgcgcccttgttcgctttgatcgtgctgctggccggcgccgtattcctgcagtcccaggtcggctcgcgccaggtgtggctgttgctgctgggcgcggccctgggcctgaccctgtatcacgccgccttcggtttcacttcggcctggcgggtgtttatccgcgatcgtcgcggcgccggcctgcgggcgcaaatggtcatgctggcgctggcggtgctgctgttcttcccggccctgggcgcgggcagcctgttcggttcgccggtcacggggctggtggcgccggccggtgtctcggtgattgtcggtgcgttcatcttcggcatcggcatgcagctgggcggcggttgcgcgtccggcacgctgttcaccgtgggtggcggcaacgcgcggatgctggtgaccctgctgtttttcatctgcggttcgctgatcgccacgcaccatgtggactggtggttcgccttgccgtcgctgccgccggtgtccatcgtgcagcgcttcggtgtggcgccggcattggggctcagcctcggtctgttcgccttgatcgccctggttacggtacgcctggagaagagccgccacggcacgctggaagcgccggtcgacagcgcgcaccagggctggcgccgcctgctgcgcgggccttggccgctggtgtggggcgcggtcgccctggccttgctgaacttcgccaccctggccctggccggacggccctggggcatcacctcggcgtttgccctgtggggcgccaagatcgccagcgggctgggggtggatgtcggcagctgggtgttctggcagggcgcggcgaacgccaaggccctggccgctccggtgtggcaggacatcaccagcgtgatggatatcggcatcgtcttcggcgccttgctggcggcgggcctggccggacgtttcgcgccaagcctgaagattcccgcgcgctcgctggtggcggcggtgatcggtggtttgctgctgggctacggttcgcgcctggcctatggctgcaacatcggcgcctacttcagcggtatcgcctccggcagcctgcacggctggctgtggctggtggcggcctttatcggcaacggcgtgggcgtgcgcctgcggccgtggttctttgccgaggagcgtcagccgcaagggctgacgggttgctgaaacgccgtgtacccaagcttttgtaggagcgaggcttgcccgcgaagggcgtaaacgatggtgcggtatagcggccagatcgccgctgcgcggctatcgcgagcaagcttcgctcctacggaagaaccgggtaatcaggtcccggccttgatcttggtccaggcccgggtccgcgcccgttccgcgtcccgtggcagcggccgcagggtgtacagcgtgctcatcgccacgtcggtcgggtacaggttggggttgttgcggatcgacggatcgacctgctcggtggcgtccttgttcgggttcgggtagccgacgaagtcgctgaccggggcgatcaccttcggttgcagcaggtagttgatgaaggtgtaggcgtcgtccgggttcttcgcgcctttggggatcgccagcatgtcgaaccagatcggcgccccttccttgggcaggcgcatgtctaccaccacaccgtttttggcttccttggcgcggttggcggcctgggagaagctgccggaataccccaccgccacgcagatgtcgccgttggcaatgtcggccatgtacttggacgaatggaagtaggtgacgtaggggcggatcttcagcagcagcgcttcggccttggcgtagtccgccggctgcttgctgttggggtccaggcccaggtgctgcagggccagcggcaggatctccgacggcgagtcgagcagggccacgccgcactgcttgagcttgctgatgttctcttccttgaagatcaggtcccagctgtccaccggcgcgttctcgccgagggcggccttgaccttggctgggttgaagccgatcaggatggtgccgtacatgtagggcacggcgaattggttgcccgggtcgttggcctcgatcagctgcatcagcttgggatcgaggtggttccagttcggcagcttgctgcggtccagcggctggaacaccccggcttcgatctgcttggcgaggaacacgttggacggcaccaccacgtcgtagccggagttgccggtcagcagcttggcttccagcgcctcgttggtgtcgaagatgtcgtagatcagcttgacctggctgttctcggccttgaagtcttccagggccttgggggtgatgtagtcgaaccagttgtagacgcgcagggtgcgttcttctgcctgtgcggcaccgcccagcagcgccgcgcagagcgcgggcgcaatgtagcttttgagcctgttcatgtggcgggtttccttcactgggcgctttgaaagccttcgagaacgttgacggcgttgatgccgatttcctccaccgcgtagccgccttccatgacgaacagcgtcggcttgcccagggcggcgatgcgttgccccatggccaggtagtccgggctgtcgagcttgaactgcgagatcgggtcgtccttgaaggtgtccacgcccagcgacaccaccactatgtcggcgccataacggcggatttcctcgcaggcctgttccagcgccgcgctccagctgtcccagccgctgccggcgggcagcgggtagttgaagttgaagccaacgcctgcgccttcgccgagctcgtccgcataacccaggaagaatgggaattcggcttccgggtggccgtggatcgaggtgaacagcacgtcgctgcgctcatagaaaatcgactgggtgccgttgccgtggtggtagtcgacgtcgaggatcgcgaccttcttgtggccctggtcgaggaacgcctgggcggcgatggccgcgttgttcaggtagcagtagccgcccatcaggtcgccagcggcgtggtgtcccggcggacggcacagggcgaaggcactgcgcgcgccgcgctggatcaccgcctgggcggtcagggcgacttgcgcggcgctgtaggccgcctgccaggtgccggcggtgatcggcgcgccgccgtcgaagctgtagtagccgagctggccgtgcaggctggtggggatcacgctgcgcagggtgcgcgccggccaggtgtagggcagcaggtcgccgtcgatgccctgggccgcccagcgctcccaggcacccttgaagaagtccaggtaggcacggctgtggatgcgttcgatcggccccaggccgaagtccctgggcgcctcgaccgggcccaggttgcgatacttcacgcggtccagcacgtggtcggcgcgcgatggcatttcgaagcagggcatcagttgcccgtcgatcagttcgcagcggccgtggtgcaggtggtgatcgtccgagtagatcgtcagcatttgttgttctccttaggctggttcggtgctcacagtcttgcggcgccggggcttttggagaacggcaggagcggccaaaaggggatcgatgtggccaaaacctgtgtccgcaattcgccccttgaaacagcacggcgccccattgcggggcgccagcggggtcagcttgcgggcggcgcttgatcgaagcgctgcagcacctggagcatgtcctcgcgttttttccgggtgaggatacccagcagcagggcgcggccgtttttctcgcagcgctggccggcactcggatcggcgcctttctccagcagcagggtgaacatgtccagggtctcctgctggctgacagtgggtgacttgtcgtcggcggaggtcttgtcggcgacgaacgtcagcaggctctggccgccgggttgttggttggagcaggtgccacgaccgtagctcaggttgagattggcaccggcttcgatcagctgcctcatggccgcgtagttgtttccccagaacgctcggtacagtgcggtttcgttgtcatccacggtgcgcagttcgaggttctgtgggtgttgcagcagccaggtgaagccttcgaggttgcgcttctgctcggccagttgcatcagcggggtgtagcctcggctgttttgctcgtcgatggcgacgccggcttccagcaggaacttcaggcgcccgccctggttcaggtcggggctgtccttgaggtcgcgctccatggccagcagggccagggtggtccatttgtactggccgctggtatgggcgccgtgggccagcagcagtcgggcgatctccaggtttggcgcgtccagggcgtgcagcagggcgctgcgcccgtcatcggccatgacttcgccactgacgccgctggccagcaagcgccggacctcggccgcgtcgccggcatccacggcggccaccagcggccagaaaccctggcacgcctgcgggttggcggacttcaggcccaggcgctgcaatacgcgcggcggcacgctcaactggcgttgcaggcgcaggccgcaatacagccgatagcgctcgatggcgcggccctggtggatattgtccagcggccgttgttcgaactgggcccagtccaggtcggccaggttgaggtaggtcggcatgcgcccaggttcccggcgcagcacctccaacagccaggggcgggcggttttcagctggccggcctcgctggtccagtaggcgatgtcgttgagcaggcccgggtattcgctgcggtcctgggccatggtgcgaaagtcatgggcggcgaagaaatcttccacctggcggatgcccggccccttgtccttggctttgcgcaattgctcatggagttcgcggaaccgcgcccagacgtcgtccgccgtggccgctggcgaataggcattgaaggtgatcggccccgtgccgctgctgaagggccggaaccacgcaggaaagcgttgcagggcgtacagccactgttgctcgatctcgctaccgatcggttgcaatggggtgaagtccatctgggtcaggtcgcggcggtgactgacagccagcatcggctgctgcggatagcgctggtcgatcagcagataacgctggctgagctgccagtccgggctgatgcagtcgaagctcaagggcgtcaggctcagcccgacttcgagttgattgctcggcggccagttgtccgagacctggatcgggtcgtccggcgagacgcaggcccgcagttcctcggggctgaacagcggcaagggcggcgacttgtagatgcgctgctggtactgcgcgtcctggtaggcgttgagataaaacagcccgcggtactggctgagcacgatccgcgccggaagctgctcaaggcctggcagggggaacggcttgatctgcagggtggcggtttccggttcgtccaggacgatatcgcgggagacttgccaccatttgatcttggccaggtccaggtcgaatgcctggacggcgggggcgatggcgagcatcagcagcgccaggccgttcgcgcaaaagcggatgtgcctggcaacgatgcctgtaaagaagttcacgtttgcagtcccttgccggtatgaaaggccggcaatgtaatgcaatcggcggttttatgccggggtttgtgtcagggccggaactggctcggggcgacgccgctccagcgcacgaaggcatggcggaagctcgcggtttcgctgaagcccagggcctcggcgatgcggtagatcggcaggtcgtcctcgaagagcatctgcttggcccgctcgaaacgcagctcgtcgagcagttcctgatagctgcaacccaggtccttgaggtgtcggcgcagggtgcgggccgagcagttcatctgttcggccaggccttccaggcccggcgcggcatccagttgcgccgccagcagctggcggatgcgcccgagccaggcctggcgcccggtgaattcggtgttctgcttgcgacagcgttcggccatggcctggtgggtgatggcgtccgccaggggcagcggctgttcgagccagcgccggtcgaaggcgaaggcgttgcaggctgcatcgaattgcagcgggcagtcgaagcgctcggcatagcggcgctggtaatcgggagcggggtagtcgaagcgggcgccgcgcaagggcagcggatggcccagcaggtcgtcgcagatgaccttcaacgacaccaggcagaactcgatattgaaggtcgccagcgccgggttctcgcggtaatccgcggcggtcagccagatcagctcgccgtccgcttccaggctcagctggaaaagtgttcccaacagcgccggataacgcagcgccaggcgcaaagcgtcacctaaggtggcactggtgagcagggcataaccgagcatgccgtagctggagacgtgcatgcgccggcccagctccaggccgatatcccgttgcagggccacggcgttggcgcacaccagcatttcctggttggtggtgatgcgggtgtcggcgcggctcaggtcggcggcgttgatgccgctgccggccagcagcgcgtcgctgggcagcccttggtccttgaaggtgttgagcaccagcgagacggcgttgagggtggtgaggtgggaatgcagcatgtccgtttccagcccgggggatgctgaaaacggagcaatttgtatgccgcgcccgcaaccaaattccaacgctggcgtggggcggcggctggatcgccgctttgcagctatcgcgagcaagctcgctcctacaagggactgtggagcttctgtaggagcgagcttgctcgcgatgacggtgaacgatgacgcgctgtcagctcagctcgccgcacaggtccagctccaccaggcgccgcacttcggcgctgtccaggccggcgccgagcagggcgttgagtttgccgaacgccgcttcgcgggtcatgccgccgccggacagcacgccgacgccgcgcaggcggctgccggcctcgtagatgtccagctccacgccgccttcatggcattgggtgatggccacgaccacgatgccctgttcccgggcgcgttgcaggctggccaggaactgcgggttatcgctcggcccggtgccgctgccgaagcactccagcaccagcgcctggatgccgctgcccagcagggcgtcgagctgttcggcggcgatgcccggcaccagcggcaatacgccgaccctggccagctgcttgccctggcggtaatccaattgcggcggaatcgaggtcgccttggctccgccgccctggcgctgcaacgccgcgaacggatgacggccgaagctgcggatcttcgcgcagcgggtcggcgccagcagttcaccatggaagtacaggtgcacgcccggcgccaggccctggccgagggcgaccagggcgccgccgaggttttcccaggcatcgctgtcggtcaccccggccggcagcatcgagccggtgaacaccacgcgggcgggcaggcccagcagctggaagctcatggccgcggcgctgtaggccagggtgtcggtgccgtgcaggatcagcacgctgtcgcagccctgcacgtcgaccgcatcgaccacggcttcgcgcaggcgctgccagtaggcgggggtcatgttggcgctgtcgatcagcggcgccatctcgcgaaagcgccagtcgggcaccaccagctcgggctggctgtgcaggtagtcgcgcatccgcgcctcgaaacccgaggccggggccaggccgtgggcgctggcctgcatgccgatggtgccgccggtgtagagcaccatgacgtgctgggcggcagggtaggtcgaagggttcatgggattctccgaaacggtgagttcctgtgggagcgggcaagcccgctccgacatttatcgcactgtaaccgacgggcgcagaggatgcgcccgccgttcacccgtcagcgttgcgctgcgggcacgccttgcggctcggcctgggtggctgccgatgtttcggcgggccaggccttcaggtccaggtccagatcggtaaatttgctggagtcgaacactggctggctgacgccggcgcggcgctgctcgtcgtagtcgcgcatcacacgcaggccaaccttgaacagcatggccagggccaccagattgacgaaggccaggcaggtcatggtgatgtcggcgaaggcgaacacggtcgacaggtcctgcatcgaaccccagaccaccagcgccagcaccaggccgcggaaagtcatcagcgcagtgcggttgcgggtgaggaactgcaggctgttctcgcccaggtagtagttgtagaggatgcaggtgaagacgaacagcgacagcgcgacgctgacgaacatgcggccccagtcaccgaccacggcggccagcgagttctgggtcaggacgatgccgtcaccttcgaagcccggggtgtagaagcccgacagcaggatcagcagcgcggtgcaggtgcagatcacgaaggtgtcgaggaacacgctgaaagcctggaccacgccttgggcgcccgggtgcttcacggcggccacggcggcgacgttcggcgcactgcccaggcccgcttcgttggcgaacacgccacgcttcacgcccatgacgatggcgctgccgagcaagccgccgaaggccgggtcgagaccgaaggcgctcttgaagatggtttccagcatggctggaacgtgttcgatctgggtgccgatcacgtacagggtcacgccgatataggccagagtcttgatcggtaccagcaggtcggacaccgaggcgatgcgcttgataccgccgatgaaggtaatggccagcagcaccgccaggacgataccggtgtgttgtgggtcgaaggcaaaggcgttctgcagcgagtgggtcacggtgtaggactgcaggccgatgaaggcgaagccgtaggtgaccagcagcaggatcgagaacaccaccgccatgcctttgagcttcaggccgtgctggatgtagtaagccggacctccacggtacaggccgtcgccatcggcgcgcttgtagacctgggccagggtacattcgaagaagctgctggacatgccgaccagtgcggtcacccacatccagaacaccgcacccggaccgccgagggtcacggcgatgccgacaccggcgatgttgcctgcaccgacacggccggcgaggctgagcatcagggcctggaacgagctgagctgcccggcgctgcctttgaggctgtcgcggaacaccgcgaacatgtggaagaagtggcgtaattgaacgaaacgcgagcggatcgtgaagtagctaccgagcccgacaatgagcacgatcagtactttccctgagaggaagtcgttgatgacttcgagcatgaagtattcctcgctgttttttgtaaaggcagaagctggacggtccgaaacatcgagttacacaccgtcgcgcagacagcacgacaggtgggccgagtgttcgtcccggttccaattcgcgggttgttattagttcgggtttcccgtgaggttgagcctcgttaccgacggccgcccacgtgaagagggggcgcactataccggtgcgcgcgcccgccgtctgcatgtagcgcgtcgagccgaggaacggcaggcggggaaaggggctgaatcggttcttgcgcaagcgccatcggcgcgcttgcgcaggcgcgccgatggcgctcgacgatctggcggtggggcaggtggagcgccgctttgcggctatcgcgagcaatcgagcgtcgaccggccgcgggcctcagaagtagtagccgatattgacattggtccggtagtaccactggttgctgcccaccgagctggtgctggtgaagccgctgccgttctccgcgccgccgtaggggttggcgttccgggcccaggaactgcgcgcccacggtgtacatcggcgagtcgtcccaggcgctctggtttttcatcatccggctgtagccgctgccgagctggcgaggctgcgaacggcaccgcaggggccgcaatccgggcgctgcggtgcatcaatggaagcgtggttggcaggttttgcggctgctgcgcacccgatcgcagcctcgccagctcggcagcggctacagcggtcgttttgcagcctttcagcggttttggcggtatgtaacagccgtacagcctttgcctcgcaacgattacgtagcaattacgtaaccgttacatagcaattacatagcgcgctagagatcccgcaccaggcgccggctcttgcggccggagacgcagaccatcatcgatcggttggctgtccgttcggccttggtcagcacgccggcgcggtggtcgatctcgccttccaccacccgcgtttcacaggagccgcagaccccttcgcgacagctgtggtcgatgtcgcagccggcttcgagcagcacatccagcaggctcaggccgggctccacgaacaaggtcttgccggactttttcagctcgacgctgtaactgctctgggcgggcatttgctcaagaactgttgcagtccttgtcgatactcctggggcggcatgaggtcactgtgttggcgatgcggcaggccaggcccttatgttccagctcggcgctggctacggtgtagaaggcgggcgtttcccgcaggtgcgcgatctgctcccaggccagcgtgctcttgccgcccttggtgttgctcaaggcaaagccccggccgctcgccgttcaggctggaaactgctgtatatgctgttccacccactcgaacaggcgctcgtcgagcagcgctcggtagcggtcgtaggcgtcctggtggctgttgaagagcgggtcctgattgacccgcgcggccagcgcggtggggctgtcgctcccggcatggctcgccctcaggtatttctgtcgctgatcggcctgttccagggtgtccgccagggcgtccagttgcaggtgcctgaattgggcgatgacctggggcaggtgaaagtgcagggcactgtcaaagccttcccagtcctcaaaggccagccactcgtggagcaccatgaagcagcgcggtgccggtgccagttgttccagcggctcgaaggccagccagtactggcgcggcagccgctcctcggtttcgatggcctgggcgatcaggtccagggcccggcccttgtctcggtgatgtttgcgcaagatgcgctgggtcagggtgaagcgtgcttcttctatagtgtgcagggcacggttcaggtcgtagccggcgttgtgcaggtattcccgggcttgctcgggaggcaggccggacttgctcgccagcacttgcagcaactcgttcttgtagagctcggcggcttgctggggattgcccgcgcagcgttcgagcaaggcctgggcatggcgcaggcccacggggatcaagctgcgcagttgctgtatcgcctggatttgcgtcgggtccatcgacggtggtgcctcggtgtctgattgggcggaaggccgattatcctccgcgccgcgggagtgtgcttgtttaaagcgagtggtttgccaggcagattgtgctgtcaggttttgcggcccctgcggccccgatcgcagcctcgcgggctcggcagcggctacggagccaatgttcgatcaggaccgatggtgtaaccgctgccgaaggctgcgatcggccgcgaagcgggcgtggcgatcttaaggacgagcgtcggcgggaggttgggagggagaacggcaggcaaaaaaaagggcttggagaagaatctccaagccctcaaaaggtgagaggtgtctagtccctcgacctggtgagcagtgccctgtggccagggcgggcgttggtcaggctttgagcgggaccagacgcggggcaatcatgttttccgggcgcaggatgtcggcgagcatggcgtcgtcgagcaagccttcttcgcgcaccagttccagtacgccgcggccgctttccagggcgatgcgggcgatacgggtggcgttttcatagccgatgtacgggttcagcgcggtgaccaggccgatcgagtgctcgaccagttcgcggcagcgctgctcgttggcggtgatgccggtgatgcagtgctcgcgcagcatgtccatggcgcgttgcagcaggcggatcgagtcgaagatcttgaaggcgatcagcggctccatcacgttcagttgcagctggccgccttcggccgcgatggtcagggccaggtcgttgccgatgatctggaacgccacctggttgaccgcttccgggatcaccgggttgaccttgccgggcatgatcgagctgcctggctggcgcgctggcaggttgatctcgttgatcccggtacgcgggccgctggacagcaggcgcaggtcgttgcagatcttcgacagcttgactgcggtgcgcttgagcatgccggagaacagcacgaaggcgcccatgtcggaggtggcttcgatcaggtcggcggccggtaccagcggctggccgctgatggtggccaggcgctggacggccagggcctggtaacgcgggtcggcgttgatgccggtaccgatggcggtaccgcccaggttcacttcggtcagcacttccggcgccagggtcttcaggcgggccaggtcttcgctcagggtggtggcgaaggcgcggaactcctggcccagggtcatcggcacggcgtcttgcagttgggtacggcccatcttcaggacgtggctgaattcttcacccttggcggcgaacgactggatcaggctgtcgaggctggccagcagcgcgtcgtggcccagcagcagacccaggcggatcgcggtcgggtaggcgtcgttggtcgactgcgccatgttcacgtcgttgttcgggtgcaggtactggtattcgcccttgctgtggcccatggcctccagcgcgatgttggcgatgacttcgttggcattcatgttggtcgaagtgccagcgccgccttgaatcatgtccaccacgaattcttcgtggaagtcgccgcggatcagacgggcacaggcttcgctgatggcagcgtgcttggcttcgctcaggtgacccagctcgcggttggcgtcagcagctgcctgcttgaccattgccagggccacgaccagttttgggtagtgcgaaatcggaacgccggagaggcggaagttgttcaccgctcgcagggtctggatgccgtaatacgcttgagcaggtacttcgagtacgccaagcaggtctttttctgtgcggaaagatgcagcggaggacatgatagaaatcatctcgatatggacccggtcggtgccggaacgctgcgaatcctaggcctgcgggaaaatttgggccaatgctgttaaacactggcctatgcataaacggcataatgtccgtgggacgccgcttgcgcggcaagcgtgtgacctaaaatggtgcgttccccgggaggacgtgatgaatctggaaagcaaatggctcgaggacttcagtgccctggccgccacccgcagcttctcgcaggccgccgaacggcgcttcgtgacccagccggccttcagccggcggatccgtagcctggaagcggcgttggggctgaccctggtcaaccgctcgcgcacgccgatcgaactgacggcggcggggcagctgttcctggtgaccgcgcgcacggtggtcgagcaactgggtgaagtgctgcggcacttgcatcacctcgaaggcgggcagggcgaagtgatgcaggtcgccgcggcgcactccctggccctgggtttcttcccacgctggatcgcccagttgcgtaacgaaggcctgaacatcgcgacgcggctggtggcgaccaacgtcggcgacgccgtgcatgccctgcgcgaaggcggctgcgacctgatgctggctttctatgacccggactctgccatgcaaatggacccggaaatctttccttcgctgcacctggggcagaccgagatgctgccggtgtgcgcggcggatgccgcaggcaagccgctgttcgacctggaaggcgaggccagcgtgccgctgctggcgtacagcgccggggcgtttctcgggcgttcggtgaaccagctgctgcgccagcgcaacctgcggttcaccacggtctatgaaaccgccatggccgacagcctcaagagcatggccctggaaggcctggggattgcctgggtgccgcacctgagcgtgcgcgccgaactggcccgcggcgaactggtggtctgcggcggcgcgcaatggcatgtaccgctggagatccgcctgtaccgctgcgccctggtgcgcaaggccaacgtccggctgctgtggcgcaagctcgaaggcggcgcggcgcagggcacaggcaacacctgatctgtagccgctgccgcaggctgcgctcgctctgggcggcactccgtcgcaggggccgaaaaacctggcgacgcggtctgtctgaaggattgggaataccccctttgcgtcggcttcgccgtcgatcgcagcctgcggcagcggctacaggaatctggcaaggattctggcccatgctgactgaccccgaagtcaataaaaccgccgctttgcgcttgaaacatggtgtatgacagatggtcggcaaaagtgcgtttaatgcacctttttcggtatactgcgcggccttcggccggttcgtccggccataattcgtacattcaagccacgcattctgcgtggcttgttgtttttgacgcgcccgcgggcgcccagagagaagaggcacgacgatgagtgcattggttggcgtgatcatgggctccaagtccgattggtccacccttagccacaccgccgatatgctggaaaagctcggcatcccttacgaggtgaaagtggtctctgcccaccgcaccccggacctgctgttccagtacgccaccgatgccgaagcgcgtggcatcgaggtgatcatcgccggtgccggtggcgcggcccacctgccaggcatgtgcgcggccaagacccacctgccggtgctgggcgttccggtgcagtcgtcgatgctctcgggcgtggactcgctgctctccatcgtgcagatgcccgcgggcattccggtcgccaccctggccatcggtaaggccggcgcgatcaacgccgcattgctgtcggcgagcatccttggcgccaagcatccgcaatttcatactgtgctgaaaaaattccgcgctgagcagacagacagcgtcctggacaatccagacccacgcatcgcctgaggtttttgacgatgaagatcggtgtaatcggtggcggccagctgggtcgcatgttggctctggcgggcactccgctggggatgaacttcgctttcctcgacccggctccggacgcctgtgccgctgccctgggcgaacacctgcgagccgattacggcgatcaggatcacctgcgccagctggctgacgaagtggacctggtgaccttcgagttcgaaagcgtgccggcggaaaccgtggccttcctgtcgcagttcgtcccggtctatccgagcgccgaagccctgcgcatcgcccgcgatcgctggttcgagaagagcatgttcaaggacctggggattccgaccccggcgttcgccgacatccagtcgcaagccgacctggaggttgccgtggccagcatcggcctgccggccgtgctgaaaacccgcaccctgggttacgacggcaagggccagaaagtcctgcgcagccctgaagacgtggtcggcactttcgccgagctgggcagcgtggggtgcctgctggagggcttcgtgccgttcactggcgaagtctcgctgatcgccgtgcgcgcccgcgatggcgaaacccgcttctacccgctggtgcacaacactcaccacagcgggatcctcaagctgtccgtggccagcagcgatcacccgctgcaggccctggccgaagactattccagccgcgtgctcaagcagctggactacgtcggcgtgatggcgttcgagttctttgaagtcgacggtggcctcaaggccaacgagatcgcgccacgggtgcacaactccgggcactggaccaccgaaggcgccgagtgcagccagttcgaaaaccacctgcgggctgtcgccggcctgccgctgggttcgaccgccaaggtcggcgagagcgcgatgatcaacttcatcggcgaagtgccggcggtggagaaagtcatcgccatcgacgattgccacctgcatcactacggcaaggccttcaaggtcgggcgcaaggtcggtcacgccaacctgcgctgcaaggacagggcgaccctcgaggcgcagatcctcaaggtcgaagcgctgctcgccgaataacttcctgaggccgcggtggaaccaattggggccgccgttctctgatggcaggatgccaaggcgctggctaggctttggcatacctaactcatacagagggaaatgccatgggaattattggaaccatctttatcggcttgatcgttggcctgctggctcgcttcctgaaaccgggcgatgacagcatgggctggatcatgaccatcctgctcggtatcggcggttcgctggcagccacctacggcggccaggccctgggcatctaccaggcgggtcagggcgcgggcttcatcggcgcgctggttggcgcggtcgtgctgctggtgatctacggcctggtcaaaaagaactgatttagcgacaaagccctctctgctgcgcaggtagagagggctagaatgcccggcgttgtcttgtccctttcttgccgagctcctccatgcgccgtcttctgttgactcttgttctgctgggcccgggcttggctcatgccggcgaactgccggaaaccgactggcttgaactgatgcccaagtcggaccagaaagccctcgagcaaatgccggaaatcgatcacaactcccccgaagccaatggcacctttaccgaaaagggtggcctgaagcagagcaaggggttgccggcggtgatgtattcgaccaagaccgtgccggccatgaacggcaaggacattcgcatcggcggttatccggtgccgctggagtccgatgccaaggggcgcagcacgctgtttttcctcgtgccttacccgggcgcctgcatccatgtgccgccaccgccgcccaatcaactggtgctggtgcgtttccccaagggcgtgaagctggacgatatctacacgccgctgtgggtgactggccacctgaagatcgagacggtcagcaacgacctggccgacgcggcctatgcgctggatgcgcagaaagtgcgggtggtgcaggagtcggatctgtaagacggcgttacagcggtacgctggtaacgctcacgcccagggtgtgactggcgcccggcgccagggtcaccacgtcatccatcacgttggcggtctcgatgcacagcatgcgttgccagccatcgtcggccatgtcgctgaactgctcggcgcgggcgatccacgggttccagatcaccgccgagcgcgagccgttgctggtcagctggatgcgtcgctcccaggccgggtcgacgatgctcagctgtggcggagggtcgaggtagatacggtcggtctcgccggtgaaatgcaggtcgccggactgttgcgcagtcttccagtcatccagggtctcgatgtaattcaggccgtccaacccttcgacatgtaccttgcgcacatcgctgaccgcgaagtagctgtgcagcgcctggctgatggtgaccgtgtcgtcgcccaggttgtggctggtgaggttgatgtgcagttggtcgtcgaggcggatgctcagcttcagctcgacctggtgcggccagcctggcagcccgccttcggggatcggcagttgcagttccaccagcaggctttcgccttcgctctggatgcccagcagttcccagtcggtggcgcggaccaggccgtgggccccggccggctcgctgccctggcgcatggcctggacgctttgcgggttgcgcgcgaagttgccgaaccacggccagcacaccggaacgccggcgcggatgcttttgccggtcttgaacacggcctcgtcgttgagccagatcagcggcggttgcccggccaattgatagctgaggatgtgcgcgccttgctgggccaccagcagttcggcctgaccgtggcggatgcgccagcagttcagttcatccagtttcaccgtttcaacgtgaggggtaggcatggtgctgttctcgttcaaaagcagggctgttatggaccacgtaacagccgccgggtttaacccacgccgaatttaacgggccctgggtggaaccgagcgggtgcggccactgccgtcgatggcaacgaacacgaacaccgcctcggtgaccttgcgccattcgctggacagaggatcgtcgctccagacctcgaccatcatctggatcgagctgcgaccgatttccagggtctgggtataaaaggaaagctgcgcgccgaccgcgaccggcaccaggaatgccatgcggtcgatggcgaccgtggcgacacgcccgccggccacgcgactggccatggcggtccccgccaggtccatctgggccaccagccagccaccgaaaatatcgccaaagccgttggtttcgcggggaagcgcggtgatttgcaaggccaggtcgccttgcgggatcggatcttcttgttcgagctctatcatgccgggggtgcctctgacccgtgactcttcattggtacttcaggtgaatagccgtcttgaggaaaaacgattcagcccgaacatactacgttcgtcacgttcttcgtaaggcgtactaaagggaaactctgcgaaaccggctggcccagtcggcgcctggggcgcccagcagcgttttcgcacagcaacccttgccggggcggcgttgctccaatgcctgcgagtatatcggtcgacaggctcggcgacgaccatccggttctgattttgattgtcaattgtgcccgtctatgtgctttttcgaacaatttgctatcgtgccgaacctgccaggccacaaccagcgctgttgcggcttccagaaccgactataagagaagcccttgccatgaccactgtgccttcgagcgtcgcgcagcccgcgcaacctgctcgtccgttgacccgcaatgactacaagaccctgtcgctgtccgccctgggcggcgcgctggagttctacgacttcatcattttcgtgttcttcgccacggtggtcggcaagctgttcttcccggcggacatgcccgagtggctgcgcctgatgcagaccttcggcatcttcgccgccggctatctggcccggcccctgggcgggatcgtcatggcgcacttcggcgacctgctcgggcgcaagaagatgttcaccctgagcattttcatgatggcggtgccgaccctgatcatgggcctgctgccgacctacgcgcagatcggcatgtgggcgccgatcctgttgctgctgatgcgggtgatccagggcgcggccatcggcggtgaagtgccgggcgcctgggtgttcgtttccgagcatgtgccgcagcggcatatcggctacgcctgcggcaccctgacctcgggcctgactgccggcatcctcctgggttcgctggtggccaccgcgatcaacagcatctataccccgggcgaagtcgccgattacgcctggcggattccgttcctgctcggcggcgtgttcggcctgttctcggtgtacctgcgccgctggctgcacgaaaccccggtgttcgccgagctgcaactgcgcaaggccctggccgaggaagtgccgctgcgcgcggtgctgcgcgaccaccgcagcgcgatcattctctcgatgctgctgacctggctgctgtccgccgggatcatcgtggtgatcctgatgaccccgaccgtattgcagacggtctatcacttcactccgaccaccgcgttgcaggccaacagcctggcgatcgtgttcctgagcctgggttgcgtggcgtccggtgcgctggccgaccgctttggcgccggccgggtgttcgtgttcggcagcgcgctgctgctggcgacttcctggaccttctaccacagcctgctggatcacccggactggctgttcccgctgtacgcgctgaccggcctgctggtgggcaccatcggcgcggtgccgtatgtgatggtcaaggccttcccggcggtggtgcgcttcagcggcctgtcgttctcctacaacctggcctacgcgatcttcggtggcctgacgccgatggtggtgaccgcgctgctcaaggagagcccgatgggcccggcctattatgttgcaattatttgcagcatcgggattctggtcggcctgtacctgtggaaaaaggatcgctgatcctgtgatcctgtgaccctgtagccgctgccgaaggctgcgaacgacccgaaggggcgcggcgatcttcagggccttggaggtcctgcggacctatcgcagcctgcggcagcggctacaaatatcttttgccccctcttaataaagaaaggccagccttccatcgcgaatgctggcctttcatctaattgtcatatttcagccatagagtgttcacacggcctacagatacttggcccgacttaacacaccctatctgctaggagtaaggcatgaaactgaagcgtttgatggcggcaatgacttttgtcgctgctggcgttgcgactgcccacgcggttgccgctgttgaccctgctatcccgagctacaccaagaccactggtgtgtcgggcaacctgtccagcgtcggctccgataccctggccaacctcatgaccctgtgggccgagcactacaaaaaagaatacccgaacgtaaacatccagattcaggccgctggctccgccaccgcgccacctgcgctgaccgaaggcacctccaacctgggcccgatgagccgcaagatgaaggacaccgaactggcggccttcgagcagaagtacggctacaagccaaccgctatcccggttgccgtggacgccctggccgtgttcgtgcacaaggacaacccgatccagcacctgaccatggaacaggttgacgcgatcttctcgtcgacccgcctgtgcggcgccaaggccgacgtcaagacctggggcgacctgggcgtgaccggcgacctggccaacaagccggtccagctgttcggtcgtaactcggtatccggcacctacggctacttcaaggaagaagccctgtgcaaaggcgactacaagcctaacgtcaacgaacagcctggttcggcttcggtggtccagtccatcagctcctcgctgaacggcatcggctactcgggcatcggctacaagaccgccagcgtgaagaccgtggccctggccaagaaaggcagcagcgacttcatcgaagacaccgaagaaaacgccctgaacggcaagtacccgctgtcgcgcttcctgtacgtgtacatcaacaaggccccgaacaagcctctggccccgctggaagccgagttcgtgaaactggttctgtcgaaacagggtcaggaagtggtagtgaaagacggctacatcccactgccagccaaagtcgccgccaaggcactggctgacctgggcctgcaggaaggcgctgcagtcgtaaaaaagtaacaccctaggtccgggcctgtcccggaccttgtaggagcgagcaagctcgcgacatgatggcgaggccaacgcagcatctgtgtctggcggctcccatcgcgagcaagcgcgctcctacacccctcaattttcgatccgctgccagctctgctccgcggcggatttgttgcgtcactgcattgtcatctttctgtcatacaggatcgctagggtgtgcgcatgaatgatctggccaactccaccatgactccgacttctccccccaagcgcattgacttcaatacgcctgagctgcaacgcaagcgccgcattcgcgcgctgaaagatcgcctgacccgctggtacgtcctcgtcggcggtctggccgtgctggccgcgatcaccttgatcttcttcttcctcgcctatgtcgtgctgcccctgttccagggcgccgacctgaccgccaaggacccgctgacgccagcctggatgcaggacgccggcaagccgctgatgttctccctggaagagcagaaccaggtcggtatgcgggtttccgacaagggccaggcactgttcttcgacatcgacaacggtgccgagctgcgccgcgtcgacctgccgatcccggccggcaccaccgtgaccgccatcggcaaggatcagccgggcagcccgctggtggtggttggcctgtccaatggccaggcgctggtgttccgtcacacctataaggtcagctacccggaaggcaagaaaaccatctcgccggccatcgaatacccttatggcgaaaccccgatcgtgctgaacgagcagggcggtgccctggagcacgtcaacctcaacgccaccgattcggcgctggtggtggccggttccagcggcgcgcaactgcacgtgctgcagctgacccgcgaagaaaacatgatgaccggcgaggtcaccagcgagcagaaccgcatcgagctgccgcagatgaccgaaccggtcaaggccatgtacatcgacccgcgccagcagtggctgtacgtgatcaacgggcgtgcccaggccgacgtgttcagcctgcgcgacaagagcctcaacggtcgctacaaactgctggaggatgccgatgccgaagtgacggccagcacccagctggtgggcggtatctcgctgatcatcggcacttccaagggcggcctggcccagtggttcatggcccgcgacccggacggcgaactgcgcctgaagcagatccgcaccttccagatgggcaccacgccgatcatcgaaatcaccgccgaagagcgccgcaagggcttcgtcgccctggacgcctcgggcaagctcggcgtgttccacagcaccgcgcaccgcaccctgctggtggaccaggtggtcgagggcgaaggcctgttcggcctgtcgccacgggccaaccgggtgatcgtcgaagccggcggcaagctgcaaccgctggtgctcgacaacccgcacccggaagtgtcctggagcgcgctgtggagcaaggtctggtacgagaactacgacgagcctaaatacgtctggcaatcgaccgcggccaacaccgacttcgaacccaagctgagcctttcgccactgaccttcggtacgttgaaggcagcgttctacgcgatgctgctggcagccccgctggcggtggccgcggcgatctacaccgcttacttcatggctccgggcatgcgccgcaaggtcaagccggtgatcgagctgatggaagcgatgccgacggtgatcctcggcttcttcgccggcctgttcctcgcgccttacgtcgaaggccatctgccgggcattttcagcctgctgatgctgctgccgatcggcatcctggtggccggtttcgttttcagccgcctgcctgagtcggtgcgcctcaaggtgccggatggctgggaaagcgcgatcctgatcccggtgatcatcctggtgggctggttctcgctgtacatgagcccgttcatggagaactggttcttcggcggcgacatgcgcatgtggatctcccatgacctgggcatcacctatgaccagcgcaacgccctggtggtcggcctggccatgggttttgcggtgatcccgaacatctactcgatcgccgaagacgccgtgttcagcgtgccgcgcggcctgaccctgggttccctggccctgggcgccacgccgtggcagaccatgacccgcgtggtgatcctcaccgccagcccgggcatcttctcggcgctgatgatcggcatgggccgtgcggtcggcgaaaccatgatcgtgctgatggccaccggcaacaccccggtcatggaaatgaacctgttcgaaggcctgcgcacccttgcggccaacgtcgcggtggaaatgccggagtcggaagtcggcggcagccactaccgcgtgctgttcctctcggcgctggtgctgctgctgttcaccttcgtcatgaacaccctcgccgagctgatccgtcagcgtctgcgcaagaaatactcgtcgctttaagaaaggtagaagtctgtgaaacagaactccctgaatggatggttcaagagcggcgccccgggcgtctggatcagcggtggcgcggtgtccatcgcggtcatcatgactatcggcctgttggcggtgatcgccgtgcgcggtctgggccatttctggccggcggacctggtgcatgcccactacgatgtgccgggccaggccaaccacctggtcatcggcgaagtggtgcagaaagaagaagtgccgcgggcacgcctgaagagcgccggcctgccggtgccggacgaaggccccgagttcatgacccgcgagctgatcaaggtcggcaaccgtgacctgaacggcaacgacttcacctggatcgtcggcgactggctgaccaaccagaccacgccgccggagctgatggccatcgagcggcgcgagtggggcaacttctacggctacctggtcaacgtcaagcaggatggcaaggtcatcgccgaaggcgaagcggcctggccggaactgcaggcgcggatcgagcgagtgaacaagctggcggcccagctcaagaccctggagaaagtcgacatcggcgcgatcaacgccggtctcgagcgcatccgcctgcacggtcgcaagctggaactggacggcaagctcgatgccgccgcccaggccgacatggaaagcgaacgcgccgagctgaacgcccgttaccaggacgtcgaggcccgcctgagcgacctgcacgcgcagttcaaccgtgacagcctcaccgcccgcgacgccaacggcaaagagatcgagatcagcctgggcaaggtggtgcacgcctaccagccgaatggcatgggcaccttcaccaagctgggtttctacttcagcaaggtctgggagttcctcagcgacgacccgcgtgaagccaacaccgagggcggtatcttcccggcgatcttcggtaccgtgatgatgaccctgatcatggcgatgatcgtcaccccgtttggcgtgctggcggcggtgtacctgcgcgaatacgccaagcagaacaccctgacccgggtgatccgcatcgcggtgaacaacctcgcgggcgtgccggccatcgtctacggcgtgttcggcctgggtttcttcgtctatgtgctgggcggttccctcgaccgcttgttcttccccgaagcgctgccggcgccgaccttcggcaccccgggcctgctctgggcttccctgaccctggcactgctggcggtgccagtggtgatcgtcgccaccgaggaaggcctggcgcggattccccgcaccgtgcgtgaaggttccctggccctgggcgcgaccaaggcggaaacgctgtggaagatcgtgctgccaatggccagcccggcgatgatgactggcatgatcctcgcggtggcccgcgccgccggtgaagtggcaccgctgatgctggtgggtgtggtgaaactggcgccgtcgctgccggtggacggcaactacccgtacctgcacctggaccagaagatcatgcacctgggcttccatatctatgacgtcggcttccagagcccgaacgtcgaggccgcgcggccgctggtgtacgccacggcgctgctgctggtgctggtgatcgcgacgctcaacctgtcggcagtgtggattcgtaaccacctgcgcgagaaatacaaggcgctggatagctaaagccattagccacaagcggcaagctacaagccgcttttgctcaaacttgcagcttgcagctagaagcttgcagctacgaacggagtgagatcatgcaacaagaagcacatacccacggcatcaacatgtcggccctgggccgcgacaagcagagcctgaacctggaccaggaaaccgtggccatcgaagtcccgggcctgagcctgttctacggtgagaagcaggcgctgttcgacgtcagcatgaacattccgaagcagcgcgtgactgccttcatcggcccgtccggctgcggcaagtcgaccctgctgcgtaccttcaaccggatgaacgacctggtggacggctgccgcgtggaaggcgagatcaacctctacggcaacaacatctaccgcaagggcgaagacgtggccgagctgcgccgccgcgtgggcatggtgttccagaagcccaatccgttcccgaaaaccatctacgagaacgtggtctacggcctgcgcattcagggcatcaacaagaagcgcatcctcgacgaagccgtcgagtgggccctcaagggcgcggcgctgtgggacgaggtcaaggatcgcctgcatgaatcggcactcggcctgtccggtggtcagcagcagcgtctggtgatcgcccgcaccatcgctgtggaaccggaagtgctgctgctcgacgaaccgtgctcggcgctcgatccgatctccaccttgaaggtcgaagagctgatctacgaactgaaatcgaagttcaccatcgtgatcgtgacccacaacatgcaacaggccgcgcgtgtctccgactacacggcgttcatgtacatgggcaaactggtggaattcggcgacaccgatacgctgttcaccaatccggcgaagaagcagaccgaagactacatcaccggtcgttacggctaggaagctgttgttgctcactgaactgacgctgcggtccaccgcaccttaccggacgctccaaggacgccaaccatgattagtaaagaaggcctcacgcatcacatctcccagcagttcaacgccgagctcgaggaggtgcgcagccacctcctggcgatgggcgggctggtcgagaaacaagtcaacgacgccgtcaccgcgctgatcgaagccgactcggggctcgcccagcaggtgcgcgagatcgacgaccagatcaaccagatggaacgcaacatcgacgaagaatgcctgcgcattctcgcccgtcgccagccggcggcttccgacctgcgcctgatcatcagcatctccaagtcggtgatcgacctggagcgcatcggcgacgaatcgaccaagatcgcccgtcgcgccatccagctgtgcgaagaaggcgaagccccgcgtggctacgtggaagtgcggcatatcggcgaccaggtgcgcaacatggtccgcgatgcgctggatgcttttgcccgcttcgacgccgacctggcgctgtcggtggcccagtacgacaagatcatcgaccgcgagtacaagaccgcgctgcgcgagttggccacctacatgatggaagatccgcgctcgatctcgcgcgttctgagcatcatctgggtcctgcgctccctggagcggatcggcgatcacgcgcgcaacatctcggagctggtgatttacctggtgcgcggcaccgatgtgcgccatctgggcctgaagcggatgaaggaagaagttgaaggcaccagtgccgaaaccgctaatgttccgggtgaagctgacgataagtaaggttgcccgagagaagcgcccggccctttggccgggcgttttcgtttatggggatttaacttgaaaagcagcgcccgcgaacgaaaagtcctggcgtgactgaagagttttggcaaagtgccatcagtaaagcgttatgctagccgggatttttaaaggggtggtcgatgagtaaggtaagtgtgttggtggtggatgacgcttcgttcattcgtgacctggtgaagaagtgtctgcgcaactacttccctggtatcaagatcgaggacgccatcaacggccgtaaagcccaggccctactggcccgtgaagccttcgacctggtcctgtgcgactgggaaatgccggaaatgtccggcctggagctgctgacctggtgccgcggccaagaggcgatgaaggccatgccgttcatcatggtcaccagtcgcggcgacaaggagaacgtggtgcaggcgatccaggccggtgtctccggctacgtcagcaagccgttcaccaacgagcagctgctgaccaaggtcaagcaggcgctgaacaaggtcggcaagctcgacaccctgatgaacagcgcgccgaccaagatgaactcggcgttcggcaatgactccctgagtgccctgaccggcggcaaggccgaagtcatcggcgccgcgccggcggctgcggtcaatccgtttgccaagcctgccgtggtgtccgctcccgctcccgccgcagccccgtcccgtgggttgctcaacagtccgccggtgaaggcgccggctcctgccgccgctgcgtctgctggtggtcgtggccagggccagttgcgcttgcccagcggtacccagcagtgcgtgatcaaggcgctgagcatcaaggaggcgctgttggtggtgaagcgcaccgatacgctgccgcaggtgctcgacagcgccgtgctggacctggagcagggcgacaatgccgaagtggcgcgtttgaacggctacctgcatgcagtggtggcctatgagccgaagccggacagcgagtggttgcaactgaccttccgcttcgtcgaccaggatgcgcagaagctcgactacatctcccgcctgatcgcccgcggcacggcgcagaaacacttcgtccccggcgcctgacgggttcctgcccgctgtttcgcgggcagccacgcctctgtaggagcgaggcttgcccgcgatagcgtccgctctgacgctgcattctccggaccgctggcccccgacctttcacatccccacacaatccctcgattgcttccttctgggctcaaacctaggctctggtttgtcgcggccaattccgcgaccgggtttggcgactcgtgttaataggcgtaacagcgccatgtatcatgtcgggcatttcgtgttcgccgtgttatggcggctgtgcgtgggagaccttcgggtctgccggttttcctatttacccggttcgccaacctgcgtacagctgccaccctatcgtttggcgacgatggctgacagctcccaaaataggagcgttatcgatgtccaagccaattcccctcaagtccaactccggcgactcccccgttctgctgatcaacccggatgcgtcgctggtcgatctgcaggccagtgccagtctgcgtttgaatgcggcgcgaaacctgctgcaaacactttcctgtaccacgcttctgcacgctgatgagggtgatctggggcgtgtcactcaggcgctgtatctgttgctggatgatggttgtgatgtgttgcaggcggcgcagtgcaaggcgttgggggagggggcagtggtttgatgccgtgtgtccgattctcgttttttcaggttgatttatatctgtactgatataggttgtggtctgtgctgttggcttttcttgtgcctggccacgctttgaaacaacccggtcgcgcgctgtggcggtcgggttgtttaacctctctggggtcagtaacgggagaggttcgatgcctaggcacaaggatgtggtgtttgtcgggagcgcgcttcgggatctccgggcttttccgctggatgcgcgaagggccgcgggttttcagctggatctgttgcagcagggcgagccgccctatgactgccggtcgatgaaaaccgtggggccgggggtgttcgagatcaggatcagtgaggattcaggagcgtttcgggtgttttacgtggccaaccggcccgcggccatttatgtgctgcacgccatgcgcaagaccacccgcaagaccgaagcgcgggacatcgagctggctcgggccagacttcaggagataagtgcacgccatgaccgatcacatgcataccgagcgtttcgccagtgtctgggacgcgctcgaaggttcgccccaggaagccgccaatatgcgcctgcgctccaagctcatgctggagctgggcaagaccatcaaggcctggggtgtttcgcagaaggaggccgccaggcggctcaatatcacccagccgcggctcaacgacgtgctcagcggcaagatcaacaagttttccctggatgcgctggtcaacctctccgacgccgcgcacctgggggtcgatatcagtttcagtccgtcggcaatggaacctctggtgcagggttgattcatacaaagtccacgtcgggctgctagcctgatttcaggctttcctcagaatcttgcccatgttcatgcacctgctgttttcctgcggtctgttgctggctgccacctcggccatggccatgaccatctacaagtccaccgacgccaacggcgtggtgtcctacagcgaccgtccgtcgccgggcgcccaagtgttcgtgtttcgcgatcgcatggtcgagcacctggaacgccaggtgcgtctggacgtcgagaagagctggggtatggacagcgtctttgtgcgtaacgacctgtatgcgccggtggagatcgagctggggtttaccggcctgaagaatatccgcagtgcccccaggcagccgattcgccgggtcctgccggcccgcagccgacagcgcctggcgcagctcacggccatgcaggcgggcaagccgctgatctatgtcccgcagtttcgttactccctgggcgaccctgcgggcgccgcccagacctatcgttacccgctgccctggcgtggtggcccctttcgcctgacccagggcgccaatggccggtacagccatttcggccccaagagccgctatgccatggacatcgccatgcccgagggcacgccgatcatcgcggcgcgtggcggggtggtggtgaagaccgagaatcgccagagcgggcgcggcaccgacccttccggcaatttcgtgcgggtattgcacaacgacggcaccatgggggtgtacctgcacctcaagcgcggctcggtaaaggtgcgtgaaggccagcaggtcgtggtgggcagcccgctggcgctgtcgggcaacaccggcaacagcagcggcccgcacctgcacttcgtggtgcagcgcaatacggggctggggctggtgtcgattccctatcagttcaaccagcccatcggcagcctgccgaacttcgcgctgggcaagaagtagccatgtagccgctgccgaaggctgcgataaggccgcaggccttcagcgatctcaagatcctgcgcccgcttcgtcggagtgccgccgaggttgatcgcagccttcggcagcgcctgcagggcgatcagcggggcgggtgtaatcaggggagagatcgcgagcaatcgagcgtcgaccggctgctcgcgatgaggtgtcaggccgtgctcaatcgagcatcaacaccttggccaggacgattttcgggcctttcatcttcttgatgatgatgcgcaggccttcgacttccatgacctcttcttcttccggtacccgtttcagggtctcgtagaccaggccggcgagggtttcggcctcgatatggtccaggtcgatgcccagcaggcgttccaccttgaacagcggggtatcgccgcgcaccagcaacttgccgggctggtaggcgaggatgccgcgctcggccttgcggtgttcgtcctggatatcgccgaccagcacttccagcacgtcttccatggtcaggtagccgatgatcttgccgtcggcttcttccaccagggcgaagtgcgaaccgcctttacggaactgttccagcagctgcgacagcggcatgtgccgggaaacgcgctccagcgggcgggtcagctcggccaggttgaacgattcggggatgtggtccagcgccgccagttccagcagcaggtccttgatgtgcagcaggccgacgaattcgttgtgctcgctgtcgtagaccgggtagcggctgaacttgtggcggcggaacagggcgaggatctgcttcagcggcgcgttgaactccacgctgatcaggtcttcccgggaattggcccagtccaccacttccagctcgcccatttccacggccgaggccagtacgcgcatgccctggtcgctggggtcctggccccggctggagtgcaggatcagcttcagttcttcgcggctgtagtggtgctcgtgatgcgggccgggctcgccctggccggcgatgcgcaggatggtgttggcgctggcgttgagcaggtagatcgccgggtacatcagccagtagaacaggtatagcggcaccgccgtccacagcgacagcagctcgggcttgcggatggcccaggacttgggcgccagttcgccgaccacgatgtgcaggtaggaaatgatgaagaaggcggtaaagaacgacacgcccttgaccacttccgccgaatccacgcccacggcgctgagcagcggcgccagcaaatgcgcgaaggccggctcaccgacccagcccaggccgagggaggccagggtgatccccagctggcacgcggaaaggtaggcatccagctggctgtgtacggtgcgcaggatctgcccgcgccagccgttcttgtgggcgatggcctcgacccgggtcgagcgcagtttgaccatggcgaactcggcggctacgaaaaagccgttgagcagaaccaggagcagtgcaaaaagaatcatgccgaagtcggcgaaaagagacgcgagggtaaaaccaggggaagggtccatgatggagttttgcgggttccgtgtattcgaaaaagagagaaatgcgcggcgcaatagccggcgcaagccagccaatgtagcggctggcagggcgattgcctagtggcgcgtggctgtcaccgctggtcggtcagggtgtcggtacgcaatcttttcacctgggccggggcgaaatggcaggtaaaagtgctgccgtggcccggcacgctgctgatctccaggcgcgcccgatggcgcagcagcacatgcttgacgatggccaggcccaggccggtgccgccggtgttggagttgcggctggagtcgacccggtagaagcgttcggtcaggcgtggcaagtgcttgctgtcgatgccgatccccgaatcctgcacgctcaggtgcgcgccttgctcgtcgccccaccagcggatgcggatgttgccctcggccggggtgtatttcacggcgttgaacaccaggttggaaaaggcgctgcgcagttccgcctcgctgcccttgagcaggatctgcgcgtcggcttccagggtgatgcgctggttgcgctccccggacagcgcctgggcatcgctcttgatcgactgcagcagcacgtcgatcggcaccggctggttgtccgacgggtagtcggtggcttccagcttggccaacagcagcaggtcgttgagcagggtctgcatgcgcccgccttgctgctgcatctgctgcagggcgcggctccagcgcggattcacttcctcgacgttgtcgagcagggtttccaggtagccgcagatcaccgtcagcggcgtgcgcaactcgtgggagacgttggcgatgaagtccttgcgcatctgttccagctggtggatgcgggtcacgtcgcgcaccagcatcaggtgttcgttgttgccgtagcgggtgatgtacagctggatgcggacccggtcgttggtcggcgaggggatttccagcggctcgttgtaattgtcctgttcgaaatattccttgaagcgcggatggcgcaccaggttggtcaccggctggccgctgtcctgcggggtcttcaggcccaacagggtttccgcggcgcggttccaccattccaggttgccgtcgctgtcgagcatgatcaccgcgtctttcagcgccgcggtggactcctggacccggtcgatcacggcttgcaggcgcccgcgcacccgttggtcgcggcgttgcaggtggtagatgctgtcgaacacctcgccccacaggccgtagccatcgggtggtgcttcatcgggttggtgcaggcgcagccattcgtgcaggcgcagcagttgcttgagggtccaggccagatagatccccaggccgatggccaggctccagccgtagtaaccgctgatcaggcccaccagcaggcagccggtgaccaatagcagcatgtggcgaatcagggtgccatgccagttctggttcacttaacacgcgtccttgtaagcgtctggcgaataaggggccggcttcaggccttggtggaaaaacggtagccggtgccgcgcacggtttgtaccagattctcgtaggcatcgcccaaggctttgcgcaggcggcggatatgcacgtcgacggtacgctcttcgacatagacgttgccgccccagacctggtccagcaactggccacgggtgtaggcgcgctcctggtgggtcatgaaaaattgcagcaggcggtattcggtcgggcccatctcggccggtttgccgtcgatggtcacgcggtggctgatcgggtccagcagcaggccgccgacttcgatcggtgcctcgccgtcggtcgggccagcgcggcgcagcacggccttgaggcgcgcgaccagctcgcgaggggagaatggcttggtgatgtagtcgtcggcgccgacttccaggccctggatcttgttgtcctcttcgcccttggcggtgagcatgatgatcgggatgtccccggtcagctcatcgcgtttcaggcgccgcgccagttcgatgccggaggtgccgggcagcatccagtcgagcaggatcaggtcgggcttgcggtcgacgatgatggcatgggcctgctgggagttctccgcctccaggcagtcgtagccggccatttccaacgcaacggcgatcatttcgcgaatgggcgcttcgtcgtcaacgatcagaatgctcctgccaaccatgcttaatcctcttgtcatttaactgtcttgcgccgcattagataacggaattattgcagtcgtgtgacagtattttaggtgctggtgcgagggctgcattcgtggactaagctttgggtccgaatcctgacaaccaccaaagaaggtttccatgactcaacacacgcactcctggaaagccctgttgctgagcgctgcgctggccctgccggggctggcgttcgctgcggaaccggcgatgaccaaagacggcatgttcgtcgatcacaagggcatgaccttgtacacctttgccaaggacagcggcggcaagtccatgtgcaacgacaagtgcgccgccaactggccgccgctgatggccgccagcggcgacaaggcgatgggcgagtggaccgtcatcaagcgtgacgacggctccatgcagtgggcctacgacggcaagccgctgtacaccttcgtgatggacaagaaagccggtgacatgaccggcgacggcaagatggacggcgcctggaaagtagccaagcctgattgatcgtagtgtttcttcgcgggccagcctcgctcctacagaaacggtaggtgtgaggctggcctgcgataacggtcctcagcgaacggcgtaatccacgactatccccaggaaaatcgccaaccccgcccagtggttatgcaggaaggccttgaagcacttcatccggtcgcgatcgcgggtgtaccagaactcccaggcaaaacacccggccgccaccagcaggcccaggtggaaccagatacccaactcgaaacgcgcgcccgccagcagcaggcacaccagcgccaggccctgcagggtcaggatgatcacccggtcggcttcgccgaacaggatcgcggtggatttcaccccgatcttcaggtcgtcgtcgcggtcggtcattgcgtaataggtgtcataacccacggtccacagcaggttggcgatgtacagcagccaggcggtggccggcagctcgccggtctcggcggtaaaggccatcgggatgccccaggagaacgccgcgcccagcaccacttgcgggtaataggtgtagcgcttcatgaaggggtagctggctgccagggccaggccgcccagcgacagccagatggtcgtcgcgttggtgcacagcaccagcaggaagctgatgaacatcagcacggcgaagaacaccagggcttccctggagctgatcttgccgctgaccagcgggcgctgttcggtgcgtttcacatggccgtcgaccttgcggtcggcccagtcgttgatcacgcagccgccggcccgagtaagggttacgccaaggacgaaaatcacgatattggccagcgaaggcgagcctttgccggcaatccacagggcccagagggtcggccagagcagcaggtagatgccgatcggcttgtccatgcgggtcagctggataaagtcccaggcgcgcggattcaggcggttgagggatttgagcaggctctgatacatcagcggttctccggctgggcgctgacggcgctccacagggacggcaggaagatttcggcgaccagcacgctcagggctgcgcgatcgaagcgcgaacggcgggcccagaggtcgtcggcctgcacctcgtcgggcagccacgggcgtgggtaatggcagacctcgatggggcggcgctgaaaggcctggtcacagaacagcagttcgcccagcgagcggctacccagttcgtccatgttcagcccgccgtcctgcagagcgctgcgggccgccacgctgcgggcgaatacccaggcctggccgtgaccgcgcagatacacctcgcgtacccagccctggctgcctggctgcaggtccagcgcggcgcattcgtcggcgcgcaggggctgccagccctcgaccagcggcgtcacgctgaagccgtcgttggaaaggcgggtcaggcgccgggtcagcgaaccttcatcgaacagccagtcgagggtctgtgcgtcggggaggggcgtcagccggctttgcgagagccagtcgggggtggaaaatgcagagattgagtgcggcacagtgggtcattattggcagcagatgaggccgcgagcttagcatggcgccaggcgattttgccgcgatggggcggccgcccgcagcgaacgtgcttgcatccgtcggtgctcatcagtacaaaacgcgctgggccggacgcgcgccctggcgtcatccagagtcgattcatcgaccatcccgccggcaacagcctgagaacctgaggaaacgcgtaaatgaaaaagtggcaatgtgtggtctgcggcctgatctacaacgaagccgatggctggccggacgacggaatcttgcccggtacccgctgggaagacgtacctgaagactggctctgcccggattgcggcgtcggcaaaatggatttcgaaatgatcgaaatcggctgatcacaccctgtgatcccctgaacctgaaggagtaaggaatgaacgcacctgtcgtcatcgtgggcaccgggctggccggctacaacctggcccgggagtttcgcaagctcgatagcgaaacgccgctgctgctgatcaccgcggatgatgggcgttcctattccaagccgatgctttccaccggttttggcaagaacaaggaagccgacggcctgagcatggccgaacccggcgccatggccgagcagttgaaggccgaggtgcgcacccatactcgcatcagcggcatcgaccctggccacaagcgcctgtggattggcgaagaagcggtgaactatcgcgacctgatcctggcctggggcgcggaaaccgtacgcgtaccggtggagggagatgccggcgaactgatcttcccgatcaacgacctggaggactacgcgcgctttcgcgcggccgcggccggcaagcgccgggtgttgctgctgggcgctggcctgatcggctgcgagttcgccaacgacctgatcctcggcggttatgcagtggacctggtggccccctgtgagcaggtcatgccgacgctgctgcaccctgcggtcgccgccgcggtgcaggccgggctggaaagcctgggcgcgcgcttccacctggggccggtgctcaatcgcttgcagcgcacggcggatggcctggaggcgcatctgtccgatggtgaggtgattgcctgcgacctggtggtgtcggcgatcggcctgcgtccgcgtatcgacctggccgccgccgcggggttgatggtcaaccgtggagtggtggtggaccggcatctcaagacctcccacgccaacatttacgccttgggcgactgcgccgaggtcgatgggctgaatctgttgtacgtcatgcccctgatgagctgtgcgcgagcgctggcgcagaccctggcgggcaacccgacggcagtcagctatggcccgatgccgatcaccgtgaaaaccccggtctgcccgctggtggtttcgccaccgccacgcggcctggaaggcgcgtggacggtcgaagggcagggcgccgacatcaaggcgctgtgccgcgatgccagcggcaaactgctgggttatgcgctgaccggggccgcggtcatggacaaactggccctgaacaaagagcttcccggcttgttggcctaaataccggtcgttctgtcggaataatcatgtgtttgccactacaaaggtcgcgcagagactggcgccactcctaactgcgtgccatcctcacacccgtctgccgcagagtagagcctgcggcgccttgggcgctgttccggaagaacagcacggacataacaacaaaaaaccgtcaaagaggcttcactatgcgtaaaccagaactcgccgctgcaattgctgaaaaagcggatctgaccaaagaacaagccaaccgcgttctcaatgccgttctcgaagaaatcaccggcgccctgcatcgcaaagacagcgtcaccctggtaggttttggaaccttcctgcagcgtcatcgtggcgcccgtaccggcaagaacccgcaaaccggtgagccggtgaagatcaaggccagcaacaccgtagccttcaagccaggcaaatcgctgaaagacagcgtcaatccataactgttgcgaactccctcgatagtagggagaaccgtattgaaaaatgggcaagccgataattcggatgcccattttttatggatggttgttcggcatataaagaatgggaatgcatgcagcaagtttcgcgaggaactacatctgtattacttagaaaacatacagactgtttgatggcaaactatcgtcttgaatgccatcatattggtggcactttacaaagttaggggcgtccgcgactgcactctttcataaaagttcagaattaggatttatttccgtacctggcactttcgattctgcctggcattacccttaatcattgaatcgctctctggtttatatcgcgcaaggctctggcccgcggcttctggcgttactggttggaatagggattccgctggttgtctagggggaaaccctgccaaatataaggcaatctcttacgaacagccgatgacagttcgtcttgtcgtttgaagggatgcttgctagtggccatcatactgattacgatgcgcgctcttgaaagagcaggctcaattggatgagtacgctcttcgatactgtccagcccgcgaaaaaagtctcgcgtgcgtatagaccgtaatctcaaaaaaggccatggatgtcctactcaagtaaactttctgcccattacctcgaactcgccaaagcctctgtttccaaagagagttttgcgggcgaggacgttcgcttctccagcgaatacgaggcactggaaagtgagctgggcaaagcccaatccatgcacgaaagcggtcagatcgactggctgaaaatcctcgaaaacagtgaagcgctgctgcgtacccagtccaaggatctgcgggtggccgcctggctcacctgggccttgtatcagcgtgaatccttccccggcctgctggccggccttggtcttctgcagcacctgtgcgaacagcattgggcgcagattcaccccgccaagctgcgcacccgggctgccgccatcggctggctggtgccgcgtctcgagcaggtgctgggcgaaaacatcgcgatcaaggagcaactgccgctgttccgccgcctggtggaacacctggaaggactcgacgccgcgctcaccgagcatctgggtgacaacgcgcccttgctgctgccgatctgccggcggctgtcgaccatggtccagcgcgccgccgacaaccagccggaacccggcgccgtgggcgcggtggtggcccaggtcaagcaggccgcgacccagctgttcacgcctggcgcgccgatcgacaacgagaaggaagcgcagaaggccctgcgtgcgatgcaggaaaacgcccgtccactgagcgcctggtggctcaagcagaaggccactgacgtacgcgccctgcgcctgaaccgcaccatgctgtggttgcccatcgatgccgtcccggagcgcaacgccgagcagatcactgcgttgcgcgggctgccggccgacaagctcaagacctaccaggagcgttttgccaatgggcaatacgccgacctgttggtggagctcgaagccagcctggccagggcgccgttctggttcgacggccagcgcatggtctgggaatgcctgcaggggctgaacgccgaccaggcgatgcgcgaagtggagtttcacttcgcgctcctgttgcagcgcctgccgggcgtggtcgagttgcgtttccacgacggcgcgcctttcgccgatccggccacccgcggctggatcagcgcccacgtcatgccccatctgcaaagcgccagcgcgccgcgcaaggtcgaagcgaccgccagccagccggcctgggaagaagccctcgaagaggtcttgccgatcctgcgcaaggacggcctcaaggccgccgtgcagatcctcaagcaaggcctgcagaacgcccatggcgggcgggtgaggtttttctggcagttcagcctggcgcggctgtgcttcatggccaagaaatacgagctggccaagacccagctcgaaaccctcgatcaagaattactgagctcgggcctgcatgcctgggagccggatcttgcgttggaagtgctgcacctcctgcatagctgctgtgagttgttgccgcagaaccacgcagtgcgagaacgcaaggaagagatttatcgcaggctgtgccacctcgacctcgaagtggtactcgaataggccccagggccaacaaccgcaaggagaaaagccatggccaaagaaggctcggtagcccccaaggaacgcatcaacgtcaccttcaaacccgccaccggcggtgctcaggaagagattgaactgccgttgaagctactggcaatcggtgattacacccagcgcgtggacgagcgcaaagtggaagaccgcaagccgatcagcatcgacaaaatgacgttcgacgaagtgctggccaagcaggagctgagcctgacgctgagcgtgcctaaccgtcttcaggaagagggcgacaccgaagagctggcggtcaagctgcgcgtcaactcgatgaaggacttcaacccggccagtctggtcgagcaagtgcctgagctgaaaaaactgatggaactgcgcgacgcgctggtggccctcaagggtccgctgggtaacgcccctgcattccgtaaagccatcgaaggcgtactcgccgacgacgaatcgcgcggtcgtgtactcggtgagctgggcctgaacgccgcagccaccgaagcctgagtctccatcagtcaaggaagccaaacactatgagcactagtgcagcacaacagaaaagcaacgagaacggcgagtacagcattctcgacagcatcatcgccgaaacccgcctgactccggacgacgaagcctacgacatcgccaagcgcggcgtgtcggccttcatcgaagagctgctcaagcctcagaacgatggcgagccagtcaagaaggccatggttgaccgcatgatcgccgagatcgatgccaagctcagccgccagatggacgaaatcctccaccacgaagacttccagtccctggaatcggcctggcgtggcctgcagttgctggtcgaccgcaccaacttccgcgaaaacatcaagatcgaaatcctcaacgtctccaagcaggacctgctggacgacttcgaagactcgccggaagtgatgcagtctggcctgtacaagcacatctacaccgctgaatacggccagttcggtggccagccggtgggcgcgatcatcgccaactacttcatgtcgccaagttcgccagacgtgaagctgatgcagtacgtgtccagcgttgcctgcatgtcccacgcgccgttcatcgccgcggccggtccgaaattcttcggcctggaaagcttcaccggcctgccggacctgaaggatctgaaagatcacttcgaaggcccgcaattcgccaaatggcagagcttccgccagtcggaagactcgcgctacatcggcctgaccgtaccgcgcttcctgctgcgcaacccgtacgatccggaagagaacccggtcaagtccttcgtctacaaggaaaccgttgccaacagccacgagcattacctgtggggcaacaccgcgtacgcgttcggtaccaagctgaccgacagcttcgccaagttccgctggtgcccgaacatcatcggcccgcagagcggtggtgcggtagaagacctgccgttgcaccacttcgaaagcatgggcgagatcgaaaccaagatcccgaccgaggttctggtctccgaccgtcgtgaatacgaactggccgaggaaggattcatctccctgaccatgcgcaaaggcagcgacaacgcggcgttcttctccgccagctcggtgcagaagccgaagttcttcggcatcagcgccgaaggcaaggccgcggagctgaactacaagctcggcacccagctgccgtacatgatgatcgtcaaccgcctggctcactacctcaaagtgctgcagcgcgagcaactcggttcgtggaaagaacgtaccgacctcgagctggaactcaacaagtggatccgccagtacgtcgccgaccaggaaaacccgagcgccgaagtgcgtggccgtcgtccgctgcgcgccgcgcagatcatcgtcagcgatgtggaaggtgagccgggctggtaccgcgtcagcctgaacgtgcgcccgcacttcaagtacatgggtgccgatttcaccctgtcgctggttggcaagctggacaaagagtaaccaggagcaaggtcatgaccggatacggcagccttttcgaacgcctgagtggcgaggccgacaaacgtgtcggctggagccgcgaggtttccgccatggcgtcggtggctgcccatctgggcaagatgctcagcacccgtgcgggcagcgtgcagacgctgtccgattacgggttgcccgatctcaacgacatgcgcctgagcttgcacgacgccctgagccaggctcgcctggccatcgaaagcttcatcgaagcctacgagccgcgtctgagcaacgtgcgtgtcgtttccctgccgcgtgatcacgaccagctcaagctggctttcaatatcgaaggcctgcttgaggtggacgggttcaagcgccaggtcagtttttccgcgcgcctggatggcagcggccaggtcaaggtcagttaaggagacgaggatgtcaggtaaacccgcagcacgcgtcagcgaccccaccgcctgcccgctccccggccacgcaaccaacccgatcgccgccggttccggcgatgtgtttttcgacggcctcgcggccgcccgccagggcgatgcctcggcctgtggcggtgcgatgtccggcggcctggcgactaccgtgctgatcaacggcaagccggcggccacagttgattcggtcgggactcatggaaatatcgttatcggtgggtcggggacggtgattatcggcaattcgcattcgccagcgcagtttgtgccgccgttgccggtagttattcctggtgttttcaatcgagtgtttgcctttaaaacggccagtgggaaggcggtagatgggttgagttaccgaatcacgtccgaaagtgggatagaaaagttcggtactgcacaggccggaaaaactggctgtttttctacggggcagaatcctgaggctgtctcgatttttgtaacgtcggagtaaggccttggaaacaatagttgaagttgatggtgtgccttacacctttgttacggaaaatggtactactgcattaaggctggataataaaaccactgccagtaatgatacaaatcctgcggatctgcatcttccagatatctggttggtgactcgttccaatggcatgcctttatttgcagtgcggcctgatgtctgtgataagccatttcgaattttaagtgctgataaactttacgctgaaaagattcaatggtttgagccgttggctgacttctatcgtgagcggctatgggtaaatcctaagagtagtgttgaaggctcggaggtgtacgatgcctacaaacagcacacatggcaaacgattatagattttgcaattgttgaccgaccatcttttgtttactacaggaatctgccgggggattggaaaaagcaatctgaagggggcgctaaatttctactttgcttagtcgaaggtgatccttattggactgacggcctgggacagattccatttgcggtggataccttccggaagtactgggaggaaacccgcgaggttgatgccgcgattctgaaaacaggtcagaccggactcgactgggctgatggaacactcggtggaagtgacaatggaagtgagaacgtatacgacaatttcataatcataagggcatgtttatgggcgtccgaaaactttgaattagtacttgagaaaaggccgatgagtgctcagaggttcgggcctagtggggcaacggtggcgagtacagtattcaagccatcttcagctacgcgactgaaaactttgattgattccggcacattggcgaaatataaaacgtggaagccatgaaattgaaaatctttgcgggcgctgtagtttattttttggttggtgttttgtatttctttgttcatgattttggcgttgcttactacaaagaaaatatgggcgggtttacagaccgtggagcagcgataggtggtactgctgagttgacgttttatttttttatttttgttaactttgttgttttttttgtaccgaagatctatttgaaaattttactgttggttttgatgttgggtgttgtgttgttctattttcttccggataacccggtaagggcaattgcatatggtgggcttacggcttctatgagcgggttggcgttagttgcgcgattggttgtggaacgatggggcggtcggaattgaagtgcgtgcagctttcgaactaaaaaattattgatcagacaggtaacccccgtgtcctttaaccactactaccaaagcgaactcaccgcgctgcgtcagctgggtcgccgtttcgccgagcgtagtccggccctggcgccgttcctgggccaggccgggcgggatccggatgtggagcgcctgctcgaaggtttcgcctttctcaccggtcgcctgcggcagaagctcgatgatgagctgccggaactcagccactcgctgatgcacttgctgtggccgaactacatgcggccgttgccggcgttcagcattctgcagttcgacccactgaagcagtccgggccggccctgcgcgtggagcgtgatacgccggtggagagcaagcccatcgatgacgtgcgttgtcgcttccgcacctgctacccgaccgaagtcctgccgctggacctgacggcgctgaattactcggtgaaaggcgacggcgcactgctcagcctgcgcctggagatgagctgcgacggccacctcggcgagctgaacctcagccgcctgcgcctgcacctggcgggcgagcgctacatcagccagatgctttacctgagcctgctgcgcaacctcgaaggcatcgaactggtgccgctgggcatggacggcaagccgttcccgggtgtcagcggcaatgccatgtcgttcaagatgcccggcaaccgcgtgcagccggtgggctttgccgaggaagaggcgttgatcccgtatccgctgaacaccttccgcggctatcgctacctgcaggagtatttcgccttccaggacaagttcctgttcgtcgacctgaacggcctggacctgctcaaatcgctgccggaggacaccctcaagcagctgcacggcctggaagtgcgcttcgacattcgcaagagcggcatccagcgcctgcggccgaccctggacaacgtgaagctgtattgcacgccgatcgccaacctgttcaagcacgacgccctgccgatccgcctcgacggcaagcaggacgagtacctgctgctgccggccgagtacgacctggaaaactgcggcgtgttctcggtggaaaccgtgaccggctggaagcccggcggcctgggttaccaggaatatgtaccgttcgaatccttcgagcacgacccaagtttcgacgtgcccagcagccgtccgcattacagcatccgccagcgttcgtccttgctgcacgacggcctcgacacctacctgagcttcggcatccgccacaccgaagcccacgaaaccctgtcgatcgagctgatgtgcaccaatcagaacctgccgcgcaagctcaagctcggcgatatctgcatggcctgtgaagagacgccggagtttttgagcttccgcaacatcaccccggccacctcgagctacgcgccaccgctgaatcgcgacttcctgtggaagctgatcagcaacatgtcgctcaactatctgtcgcttgccaacgtcgatgcgctcaaggtgattctcgaaacctacgacttgccgcgttactacgaccagcacctggaaaaggtcagcaagcgcctgctgggcgggctcaagtcgatccgccatgagcatgtcgaccggttgcatcggggcctgccgctgcgcggtctgcgcaccgagctgaccatcgatccggaaggctatatcggtgaaggcgacatgttcgtcttcgcctcggttctcaacgagtttttcgctctttacgccagtctcaactcgtaccacgagctgcgggtaaaaagtacacagggagaggtgtaccaatggacaccacgtatgggtctacagcccctgctttaagcgggctgacccgggtcattcgcgagtactcgctgtttcaggccgtgctgctggtggtggaccggctgcgcgattcccatccgggcctgagcgaagaggatctctacgaccagctggaattccaggccaatccgagcctggggttccctggcagcgacgtcgatcgcgtggaatttttcgaagagcacgggcaaatgcgcgcgcgcctgcggttcaacctgatcgggctcttcggctccggctcgccgctgccggcgttctatggcgagcaggccctgggcgacagcgaagacggcaacccgacccgcaacttcctcgacctgttccaccatcgcctgcaacggctgatgctgccgatctggcgcaagtaccgctaccgcgccagtttcaagagcggcgcgctcgacccgttttccgcccagctgttcgccctgatcggcctcggcggcgaggacatccgcaaggccaaggagctgaactggaagcgcctgctgccgtacctcggcctgctcagcctgcgggcccactcggcggcattgatcgaggccgtgctgcgctactacttcaagcatgcggacctggtgatcgaacagtgcatcgagcgccgggtggagattctcgaagagcagcgcaaccgcctgggccgcgccaacagccagctcggcgaagacctggtgctgggcgaacgggtgcgcgaccgcagcggcaagttccgcatccatatccgccagctcgactggcaacgcttccacgaattcctgccgatcggtttcggctaccagccgctgtgcgcgctggtgcggttcaccctgcgtgacccgctggactacgacattcgcctggtcctgcgccaggaagaaatccgcgaactgcgcatcggtgagcagaacgcctgtcgcctggggtggaccagttggctcggccgcgaacgcgcggacggcgtggtgaccctgggcagcaaaattcattaaggacagatgacatgatcaacgtagacctgcagcaactgatccaggcgctggacgccgaaacccgccgtgacctggaaagctccgctgaacgctgcgtcgcccggggcggcagcaagatcctggtcgaagacctgctgctgggcttgctggagcgcccgcaaggcttgctcgcacgcgcgttgcaggacgccgaagtggatgccggcgagctgagcgcggcgctgcaatcgcgggtcgaacacagcgcctcgcgcaacccggtgttcgccccggagctggtgcagtggctgcaggacgccttgctggtggccaacctcgaactgggccagagccaggtcgagcaggcggcgctgatcctcgcgctgctgcgtaacccgatgcgttacgccggtagccgctaccagccattgctggccaagctgaacatcgagcgcctgaaagatttcgccctgtcgcagaaggaagagccggccaatggcaagccggcggcgccgggcgagtcgctgttgcagcgcttcacccacaacctgacccagcaggcgcgcgagggcaagctcgacccggtgctgtgccgcgatggcgcgatccgccagatggtcgacatcctcgcccgtcgccgcaagaacaacccgatcgtggtcggcgaggccggtgtcggtaaaactgcggtggtcgaaggcctggcctcgcgcatcgccgccggtgaagtgccgcaagtgctcaagggcgtcgagctgctgtcgctggacatgggcctgctgcaagcgggcgccagcgtgaagggcgagttcgagcgccgcctcaagggcgtgatcgacgaggtcaaggcttcgcctaagccgatcattctgtttatcgacgaagcccacaccctgatcggcgccggtggcaacgcgggcggttccgacgcggccaacctgctcaagccagccctggcccgtggcgagctgcgcaccatcgccgccaccacctgggccgagtacaagaagtacttcgagaaagacccggccctggcccgtcgcttccagccagtgcaactgcacgagccgaccgtcagcgaggcggtgaccatcctgcgtggcctggcccaggtctacgagaagagccacggcatctacctgcgcgacgatgcggtggtggccgcggccgaactgtcggcccgctacctggccggccgccagctgccggacaaggcggtggacgtactcgacaccgcctgtgcccgggtgcgcatcagcctggcggcggcgccggagagcctggagcgcctgcgtggcgagctggccgaaggcggccgtcagcgtcaggcgttgcgccgcgatgccgaagccggcctggtgatcgaccaggaagcactggacgcgttggaggcccgcctggccgaggccgaggccgagcagcaagccctggaaaccctgtggagcgaacagcgcaccctggccgagcgcctgctcgaactgcgccagcaactggccaaggcccgcgatgcggccaaccagccgccgcgggtgtcggtggaagaagacgccgaaggcacggtgatcgaaacccttgccgctgaagtggaagaagggcagagcgtcgaggcactggaggccgcgctcaacgaaacccatcgcgccctgagcgatgcccagagccaggagcgtctggtcagcttcgaagtctgcccgcgcctggtggccgaagtgatcagcgcctggaccggcgtgccgctgacgcaactggcccgtgaacacaacgccaaggtcgcgagtttcgccagcgacctgcgcgcgcgcattcgtggtcaggaacaggcggtgcacgccctggaccgctcgatgcgcgccaccgccgccggcctgaacaagccggacgcgccggtgggtgtgttcctgctggtgggcccgagcggcgtcggcaagaccgaaaccgccctggccctggccgacctgctgtacggcggcgattgtttcatcaccaccatcaacatgtccgagttccaggagaagcacaccgtgtcgcgcctgatcggcgcgcctccaggctacgtcggctacggcgaaggcggcatgctcaccgaggcggtgcggcagaaaccctattcggtgattctgctcgacgaggtcgagaaagccgacccggacgtgctcaacctgttctatcagatcttcgataaaggcgtggccaacgacggcgaagggcgcgagatcgattttcgcaacaccctgatcctgatgacctcgaacctggccagcgaccgcatcagtgcgctgtgcgagaacggcgagcggccgagcgccgagaccctggaagagaccatccgcccggtgctcagcaagcacttcaagccggcgctgctggcgcgcatgcgtgtggtgccgtactacccggtgggcggcccggtgctgcgcgaactgatcgaaatcaagctgggccgtttaggtgaacgcctgaaccgtcgccagctggatttcactcactgccagaacctggtcgaccatctggccgagcgctgcacccagagcgaaagcggcgcgcgcctgatcgatcatttgctcgacctgcacgtactgccgctggtggccgaccgcctgctggacgccatggccaccggcgagaacctcaagcgcgtgcacgcgacgctcgacagcagcggcggcgtgacctgcgagttcgcctgaggtgggtgtgatgttcactcgtgtaccgcaaccgctgatctacgccgaggcgctgctggcgcagttcgccagcctgtcgcgggcggccgacggtggcgcgctgctgggtgatttcgtgcgcggcgtggccgggctcagcggttgcgagctgagccagctgtacttgctcgatgccactcatacccggctcggcctgagcgccgaatgcctgggcggcatcctgcaaccgcgggaggcggcaagcctgccggcggactacaacggtgagcagttgctgcagttcgccctgtgccagaaccgcgtggtgagcctggtggggctgagcggcagcctgcacgaaaccagcttcctgccggcccgggatacaccctggcagtcgctgttgtgcgtgccgctggtgaacacgcaaaaggctgtcgaaggcctgctgctgtgtgccagtcgcgaacatgtcgacctgcagggcttcgccgattccatggggcaactgggctcgttcgtgctcgggcaactgcacctgctgcaacgcctgcggcgtccagtgggcgacgcggcgccggtggccagcactccggtcagcgccagcggctacgggctgatcggcaacagcacggccatgcgccagacctaccagttgatcagcaaggtgctgcacagcccctacaccgtgttgctgcgcggcgagaccggcaccggcaaggaagtggtggcgcgggccatccacgactacggcccgcgacgctcacaggcgttcatcgtgcagaactgcgcggcgttcccggagaacctgctggagagcgagctgttcggctaccgcaagggcgccttcaccggcgccgatcgcgaccgtccggggctgttcgacgcggccaatggcggcaccctgttgctggacgaaatcggcgacatgccgctgtccctgcaggccaagctgctgcgcgtgctgcaggagggcgagatccgtccgctgggctccaacgacacccacaagatcgacgtgcgcatcatcgccgcgacccaccgcgacctggcggtgctggtcagcgagggcaagttccgcgaggacctgtactaccgtctggcgcagttcccgatcgagctgccggccctgcgccagcgcgaaggcgacatcctcgacctggcccggcacttcgccgacaaggcctgcgccttcctccagcgcgacccggtgagctggtcggaaaccgccctcaatcacctctcgggctacaccttcccgggcaacgtgcgcgagctcaagggcctggtggagcgggcggtgctgctgtgcgaaggcggcgagctgctggccgagcatttctccctgagcatcgaagcgttgccggaggaacccgggctgaacctgcgcgagcgcctggagaaggtcgagcgtcatctgctgctcgattgcctgcgcaagaacgacggcaaccagaccctcgcggcccgcgagctggggttgcccaggcgcacgctgctgtaccgcctcgggcggttgaacatcaatcttggcgacttcgagggctagcgcgacatgactgccccaagcgcctttttcgtttcgccaggcgtcgcccgcaagggtcggcgctttgtgcattgtctacccatggagaccctctgatgtttgttcgtcactggcaagccgccctgctggctctgatcgttctcagcggcctcggcggctgtagcggtaattacaaattcaacgacaacacctatcgcccattgggtgatccgcaggcggtcaatcgcggcaagtgaccgcaaggagcatcatcatggaactggttttcgaaatgctgaacaccaagcagttcgtgcccacggagttgagcagcaaaaccttcaagcaggccggcggagtgatcgggcggggcgaggattgcgactggatcattccggaccgcaagcgccacctgtccaaccaccatgcgatcgtcagctaccgcgacgggatgtttttcctcaccgataccagcagcaacggtattcaggccagtgacagcggcgcgcgcctgcgcaagggcgagccgcagcgtatcgagcacggcagcgtctatgtgctgggggacttcgagatccgtgcgcgcctggtgcgcgatccggcgaccttcgacgccgaggtcgggcgtccgcaggccgccggcagcatcattcccgatgacgccttcctcgacctcgacccgctcaacgcgctggaccagcaggagcgggtgtattcggaaatcgacgagctgaccgcgctcaacacgccgcgccaggaaccacggcagcgcgcggactatgcgcgcatcgacatggaaagcctgctggtgccggaactggtggcacagcccgaggcgccggtcgctgtcgagccggccccggtggaacgccagagcgaaggcttctgggagcatttcggcgcggcgctgggggtggacctcaaaggcctcgaccacgacagccgcgaggccctggcgctcaatgccgcgcgtttgctcaagcaaagcatcggcggcctgcagcagagcctgcgcacccgcagcgagctgaaaaacgaactgcgcctggccctgaccaccgcccagggcggcagcaagaacccactgaagttcgccgtggacgccagcgaagcgctgggcatcctgctgcaaggcaacaagcccggccagctgccggccgagcaggcgatctcccgtgccttccgcgatctgcaggcgcaccaggtggcgctgctgaccgccagccgcgcggccgtgcgcggcaccctcgagcatttctcgccgcagcagctgaccctgcgtttcgagcgcgacaacaagccgttgctggccacctccggcagccgctggagagcctacaaccgctatcaccaggccctgcgtcaggacgatgactggagcgaacgcctgctggcccgtgacttcgcccaggcctacgaagaacagatccgcctgatctccacccttcacaccgaacaccaaggatgatgcgcatgtctcgctgctcgaccctgttactcaagacgctggccatgctgaccgccctggcgttgctggccggctgctcgtcgctgtcgccgtactcgaccatgaccaagctgaacctcaagctgaccgccagcgaccagctcaacccggatctcaacggtcgcccgtcgccgatcgtggtgcggctgattgagctcaagcatccggtggccttcgagaatgccgatttcttcagcctctacgagcgcgccaaggagtccctggccccggacatggtggccagcgaagaattggaactgcgcccgggtgaaaccgtggaactcaagctcagcgtcgaagaaggcagccgctatgttggcgtgctggcggcctaccgcgatatctccgaagcccagtggcgctatgtggtgcagctcactccggtggagctgaccgaagccgatctgaccctcgaccaggccggtatccgcaccagcaacgcaacgctcgccaaggcggacaagtaatcatgaacgtgcataaagtcatttggcaggaaggcatgttgctgcgcccgcagcacttccagcacaacgatcgctactacgactaccagatgaaaacccgcacccagttgctgggcagttattcctggggtttcctgagcctggagatcgacctgcagttcctcaacatgggcaagctggtgatcagccaggcctctggcatcctgcccgacggcagcctgttcgaactggggggcaacaccgagccgctggccctcgacgtgccgccgaacaccggcaacaccccggtgtacctggccttgccgctggtgaccggcaaccacatcgaggcgcgccgtccggagcagtccgatgtgctggcgcgctacaccacctacgaggcggaagtggccgactccaacgccggcgacgattccagcagccaggtcagctgcgcccggccggacttccgtctgctgctgggcgagcaacagagcgaccaggcctatgtgaagctcaagctctgcgaagtcctcgacaccacgcccgacggggtgatcagcctcgacccggacttcgtgccgaccttcatccacgcccatgcctcgagctacctgctgtcgtgcctgaaagaagtgatcagcatgctcagccaccgtggcgacaccattgccgaccggatccgttccaacggcaaggtcggcggcgccgaagtcggcgacttcatgatgctgcaactgatcaaccgcaccgagctgctgctgcgccactacctgggcctggagcaggtgcacccggaagagttgtaccgcacgctgctgaccatgctcggcgatctggcgaccttcgccagcgacagcaagcgcccgcgcctggacagccgctaccagcacagcgaccagggcgcgagctttcgcaagttgatggacgcgatccgccaggtgctgtcgatggtgctcgaacagcacgccatcgagctggtgctgcaggcgcgtcagtacgggatcatcgtgtcgccgttgcacgaccacaagctgctggggtcggcctcgttcgtcctggccgccagtgccaactgcgactccgaagaactgcgccatcgcttgccggcgcacctcaaggtcggcccggtggagcggattcgccagctggtcaacctgcacctgccggggatcaaggtcaaacccttgccggtggcgccacggcagatcgcgttccactccaacaaaacctatttcatcctcgaactcagttccgaagacctggcgcaactggagcgttccggcggtttcgccttccacgtgtccggcgaattcgccgagcttgaactgaaattctgggccatcaggaactgaccgacatgatcaaggacatggaacacaaccaggacgacaagaccgtcctgctcgatcgccagggccatggcccggcacagagtccgctgaccgatttcgccgcgccgccgcgcttcgagcaactggaagaacggatgatctacgccgcgcgcctgcgcccggccgaggccttcaacatcagcctgaacgcgctggtggcggcggcctccgatctgttgtcggaagtggtgcgcctcaagcacagcgacacccgcgaagacctgtacgcgctcaacgagcgcctgacctcggccttgaagctgttcgaggtgcgcgccctgcacaacggcgccgaaagcagccaggtcatggccgcccgctacgtgctgtgcaccgtggtcgacgaggcggtggtcactactccgtggggcaatgaaagcgagtggtcgcagatgagcctgctcagcagcttccacaacgagacctttggtggcgagaagttcttccaactgctggaccggctgtcgaagaacccggtcaagcacctgccgatgctggaactgatgtacctgtgcctgtcgctgggcttcgagggcaagtaccgggtcatggcccgcggcatgctcgaactcgaaggcattcgcgatgcgctgtaccggcagatccgtcagctgcgtggcgacgtgccgcgcgagctgtcgccacactgggaaggcttgcacgacaagcgccgcagcctggtgcgcatcgtgccgtggtggatggtcgcgctgttcacggtggtctgcctggtggtgatgtattcggggttcgcctgggttctgggcgagcagcgcgagaccgttctgcaaccttatcagcagcttgacccggccgtggtccagccccagccgtaatacagggacgtgtgatgaaaaacttcttcaagaaagtcggcgccttcctgcgcaagacgtgggtctggacgctgttgctggtgctgttcgtggcactgctggtgtggttcgtcgggccgctgctggcggtcaacgactacaagttctgggaaagcgcgacctcgcgcctgctgaccatcagcgtgctgttcctgatctggggcctgaccatggtcttcgtcagctggcgcgccggggtccgcaagaaagaaatggaagacagcgaagacggccaggaacgcctgcgccgcgaagagctgatcgacgaggaacagaaagagctgcgcagccgcttcaaggaagccatgcgcaccctcaagacctccagcctgtaccgcgggcgcagcgagcgctggcgcaacgacctgccctggtacctgctgatcggtccgcagagcagcggcaagaccagcctgctggacttctcgggccttgagttcccgatcaacaagatcgaccgcaagctgacccgcgacaccgtcggcacccggcattgcgactggtacttcgccgaccatggcgtgctgatcgacaccgccggccgctacctgacccagcctgacgcggaagtcgacgccagcgcctggagcaccttgctcaacctgctgcgcaagcgccgtcgtgggcgtccgctcaatggcgtgctggtgaccattccggtggagctgctgctgagcggcaacgagcaggatctcgagaccctggcgcgccaggtccgcgcgcgcctgcaggacgtgcaccagaaactgcatgtcgatgtgccggtgtacctggtgctgagcaaggccgaccagttgttgggcttcgacgagttcttcgaccagctgagccgcgaggaaagcgaccaggtgctcggcaccagcttccgcaaggagcagaacggcaccgacgtcgccgtgctgcgccaggagttcgaagaactgctgcggcgcctgaacagccaggtgatcatgcgcatgcaccaggagcgcgacacccagcgccgtggccgcatcctcgacttcccgcaccagttgggccagatcggcgagcacctgtgcctgttcgtcgacatggcgttcaccggcaaccgctaccagcgggccagccagctgcgcggtttctacctgaccagcgcgccgcacctgaccgaaaagctcgaccccgacaccgccagcatcggcgccagcctgggcatggcggccggcgtgctgccgaccctgcgcagcggccgttcgcgctttattcaccacctgctgagccgggtgattttccccgaggccgacctggctggcctggacaagcgcgagcgtaatcgcatccattggggtcagcgtgcgctgtacgttggcgcgctggtggccctggccttgttcggcctgctgtgggccggtggtttttccgccaactatgagcgcctggaaaacctgcgctccctggcgcagaactggaaccagcagcgcaccgcgctgaccacccgcgacgacgcgatggcggcgctcaagaccctggacaccagcttcgaagccaccaaggtgttcccggccaagggcgacgtctcgctgcacgagcgggtcggcctgtaccagggcgaggaaagcaacccggtggtgctcagcgcctacgagcgtgagctgcaagcccagctgttgccacgggtggcgcagatgctcgaagggcagatccgcggcaacatgcgcgaccgcgaccgcctgctcaacagcctgcgggcgtacctgatgctgaacatgcaggatcgtcgcgatccgtcctggctcaaggattgggtagccagcgactggtcgacgcgctacgccggcaacaccgcggtgcagaacggcctgaacgcgcacttcgagcgcctgctcaaactgccgttcagctacccgctcaacgacacgctggtggcccaggcgcgccaggtgctgcgcagcgagtcgctggccaacgtggtctaccgcgtgctgcgcgaacaggcgcggagcctgccggagtaccgcctgagccagcacctggggccgcagggtagcctgttcgtcggcaccgactacgcgatcccgggcttctacacccagcagggttaccagcagtatttctcggtccagggcacggcgctggtcaccgatatcctgcgtgacaactgggtgctgggcgaaggcagcggcatcagcggcatggacctgcgccgcctgatggtggagctggagcagctgtacttccgcgactacgccaatttctggagcgaagcggtgggccaggtcggcctgcagccgttcaacgatgccggcgaaggcgccgatcaggtcgccggcctgacctcggccaactcgccggtgctgcaattgttggtggaagtgcgtgagaacacccgcttccaggccatcgccgaaagcgccgaagacgtgaccgccgcggcggacaaggccgccgagaagggcggggcgctgggcaaggtcgcggcggctgccgcgggcaaggcccaggaagctttggccaagaacctgccggacaccgcgaagaagtcgctgcaacgtcgcttcgaaccgctgcaccgcctgctggacgacaacaacggcccggcggcggatctgacgccagcgctgcaagcgttgaacgacctgcaactgcaactggccggcctggcccgtgccagcgcgcccgagcaggcggcattcgagatggccaagacccgcatgagcggccagcgcgatgccctgagcaacctgcgcaacgcctcggtgcgcctgccgcgtccggtgagcgtgtggttcaacgtgctggcggaagacacctggcgcctggtgctcaacgactcctaccagtacctgaaccagcgctaccagagcgagctgtacagcttctacggcaaggccatcagcaagcgttatccgttcagtgcccacagcaccagcgatgtcgccatcagcgacttccgcgagttcttcaaggcccagggcatcgccgaccgcttctttgaaacctacatgcggcctttcgtcagcggcgatccgggcaactaccgcctgcgcagcatcgacggccatagcctgccgatgtccaaggtctacctcgaccagatggccgcagcccaggtgatccgccagagcttcttctcggagaacccggcggagccgcaggtgcagttcaagctggagccctacaccctggacccggcggtgagccgttccgagttccgtttcggcgacaagaccatggaataccgccacggcccgatcgtgccggtgtccttcaagtggccgaccgacgccgaagacggccgcaccagcctggtgctggacaagatggccgggcgcccggtgggcatcgaaaagaacaccggcccctggtcgctgttccgtctgttcgacctgatgcagaccgagtacctgaccggccgtgacgtgctggtgctcaaggctgacctgggcggcctgcgcgccaactacctgctgatgagccagcgcacgccgaacccgttcgacatgggtgtgctgcgtaccttccgcatgccggtgcagctctgatgctggttgccagtacctggcgcagcgctgcgcgcaccgacccgggcaaggttcgggcgcgcaacgaagatgccttcctcgactgtccggagcaggggctctgggtggtcgcggacggcatgggcgggcatcagggtggcgacatcgccagccagttgatcgtcgccagcctggccgagttgccggcgcaagacagcttcgacgagcggctcaagggcctgcgccagtgcctgcactggctcaaccggcgcctgggccaggagttgaccgtcaccgccgagcgccacgacagcatcatgggcagcaccgtggtcgcgctgttgctcgaaggcgaccgcgcagcgtgcatctgggccggcgacagtcgttgttacctgtggcgcgggcagcgtctgtaccagctgtccaaggaccattcgctgcagcagcaactgatcgacgagcagcagatgagcgtcgagcaggcgcgggcccatccggcagccaatgccctgacccgggcggtgggcgccagcgagcagctgaccctggatgtgctggagttgcaggtctaccccggcgatgccttcctgctgtgcagcgacggcctgtatcaggggttgaccagcgatgcgctgggcaatgccttgagcctggcttcgccgcaggtggcgctggagcgtctgttcgacggcgccctgcgtggttcggcgcgggacaacttgacagccgtggtgatccgccaatgagtgatctcaaatccggtctggataacatcctgatgagcgaggaagaggccagcaacctgacctatttcgccttcgccaaggccaatgaggcgccgcgtcccgtggcgcccaaggccaagggcaaaggccgcaaccgctccaggaaccgcccccgttccaaggcccaggccgtggtgcctgtgggcgggctgccggacgtgctggccggacgttaccgcctcgagcgcctgctcggggccgggggcatgggcgcggtctaccgcgcgcgagacctgctgcatgagcagttcggcgatcccgacccttacatagcgctcaaagtcatgagcgaagaattttccgagacgccggatgccagcgccttgctctacagcgagttcgccctgacccgacgcctgcgccacccgaacgtcgtgcgcctgcacagcttcgaggtggacacccagtgccagcgtgccttcatcaccatggaactgatgcgcggcctgaccctggacaaactgctctgcgagcggccgttgggcctgccgtgggaagagctgcgcgatgtggtgtggccactgctcgatgccctggcgtacagccacgctcgcggtgtgctgcacggtgacctgaagccaagcaacgtgatgctctgcgaagacggcgtgcggctgttcgacttcggcctgagccaggccgaggagggcatccttcccggcctgccgcaactgagccgcagccgcttcaacgcctggacgcccggctatgccgcccccgaattgctggagggcggcgccttgtcggccagtgccgacctgtacgcggtggcctgtgtgatctatgaactggcctgcggcaagcacccgtatcgccggttgccgtcgacccaggcccgcgacgaacgcctggaccgctcgctgcaagtgcccaggcatctacccagacactgttggccagccctgcgcgcggcgctggccttcgacgtggcggaacgcaccatctctgcccaagcattgcgcgatgccatgcgcgcggattcgtcctggctgcaacgctggttccatcggcgtaacggatgaccatcgaacagggagcaagctatgttcaatccttccaatgaaacccacttcagcctgacggtcgacgacttccagggtgacttgcaggtgctgtctttcgaggggatcgaaggcatcagccagccgttccgtttcgatctggagctggtcagcgagaaccccgacctggacctggaaaccctgctgcacaagcaggcgtttctcgccttcgatccgcaaggcagtggcatccacgggcagatctacggcgtggcccagggcgatgccggcaagcgcctgacccgctacaaggtgtcgctggtgccgcagctggcttatctcgaacatcggaccaaccagcgcatctaccagcagctgtcggcaccgaagatcatcgcgctgatcctcgaagagcacggcatccagggcaacgcctaccggttccagctcggcacgccgtgcccggaccgcgactactgcgtgcagtacgacgaaaccgacctgcatttcatccagcgcctgtgcgaagaggaaggcctgcattaccacttccagcacagcccgcagggccatctgctggtgttcggcgacgaccagaccgtgttccccaagctcggccagcccaccgcctatatccagggcagcggcatggtcgccgacgagccggtgatcaagggtttcaacctgcgcctggaaacccgcacccgccgtactactcgacgcgattacgacttcgagaagccgcgcctgcaattggaggccgcctataaacccgaagctgaaagcgaagaaccggacctggaagactacgactacccgggccgcttcaccgaccgcgcgcgcggcaaattcctcagccagcgcgccctcgaacgccaccgcgccgactaccagcaggctgaaggctggggcgaccagacgcgcctggtcagcggccacttcctggaactgtccgagcacccgcgcagcgagtggaacgacctgtggctgctgacccacatcgttcatgaaggcaagcagccgcaggtactggaagagtcggtgaccagcgacaccaccgacaacaaggatgacttccaccagggctatcgcaaccgctttctcgccacgccctggcaggtgttctaccgtccggccctgaaccacccgaaaccgcgggtgctgggcagccagaccgcggtggtcaccgggcccaagggcgaagaaatccactgcgaccagtacggccgggtcaaggtgcagttccactgggaccgcgagggcaaagccgacgacaagaccagctgctggctgcgcgtgtccagcagttgggccggcgaccgctacggcgccctcgtcatcccgcggatcggcatggaagtgctggtgaccttcctcgagggcgaccccgaccagccgctgatcaccggctgcctgtaccacaaggaacatccggtgccgtacgccctgccggcgaacaagacccgcaccctgttcaagtccatgagctcgccgggcggcgccggctacaacgaactgcgcatcgaagacaaaaaaggcgccgaacagatcttcatccacgcccagcgcgactgggatgaaaacatcgagcacgaccagaaaatccgcatcggccatgaacgccacgacacggtggaaaagaacacctacaccgaactcaaggccgaagaacaccgcatcacccacgccgaccgcaagatcgaaaccaaggcggacgaccacctcaccgtgggcgaaaaccagcacatcaaactcggcaccgcgcaactgaccaaagccggccaggaaatccacctcaaggccggcgccaagatggtgatcgaggcgggcagcgaactgacgatcaaggccggggggagttttatcaagctcgatgccggcggcgtcacggtggtggggccggtggtgaagatcaatgcgggaggttcgccggggagtggtaccgggatcggcattctgatgccgggcctaccgggcgcggccgatgcggacaaggctggcagcctgatggaggaagcattggccaacccggcgaaagaaaccgtgccgggtcagctgtgcattcgtatttccccgttgcccaacatgccggggtatccggatgagccttatcagctctacgccgatggtgcacttatcgacaaaggcttcagcgacgagaagggcaatgtgcttttccagcatattcccggtacccgcaactattcggtggaaacggtgaacggacaccgtttcaacctggatatgagcgaaacctcgagcgaacagacgcgccaacgcagtgagcgcttggggcgtgagggataccgcgacttcccgggcgcagctgcctctctggaggcgttaagcagcagtgaggcgttccgccaattgtgggcggatcaaagcgagcagaaagagtaaaggaagcactccatgacatacctcgatcagaaactgtcgatctcgcttgaagaaagcgccgcaaccctgacctcggattggttcgcccacaagaacaatccgctaagcccgccacgcccggcaggcaacgtagtgacgccgctggtgtgtggcgaggaggcctttgaaaaggtctatgactgcatcctgaacgctacgaaaagcatcgatctcatcagttggggcttcgacccggggatgcgcctcaaccgggcttcgaccgatagcctcagcctgggggacttgcttaagctgaaggccagcgatggcgttgaggtgcgggtactgatctggaacaaccgactggcccagctcggcgaaaactcggttatcggcgagggctggagtggcaggggcggaacatcgatgggttccggaatgactgcgggcaagccggctgacaccagcgccctgggtgataaacggaaaaagctcctggaagaacagcagcaggagcaggcacgcctggaaaaacttccggcaaacgacgaggccggccgacgagccacgcgcgaccgtctgatcgacatccagcaaagcctggatgccctggacagcggctacgtcaagggtcgtgattcgggagggacggtccaggacccgaacgaacaggtcaagacccgcaattggtatcgctgggtccacagcggtgaagcccgcaatatcgagtttcgtacgcgggacttcaaactcgtaggagagttgacctacgacgatcaaaatggcctgcgcatgcattgggggcgtcttgccatcctgtggcgactgctcaaggacgagtctcacgatgtgcccttcatgcagatgctggccctgagcctatttcccagccatcaccagaaaaccctggtggtcgactacatggacccgcaaaaagcgaaaggtcttgtgatgggccacaacctgcagcgcaactactgggacaccactgcccacgcctacgacgatgcagccggcaagcgcgatctgggcttcggcccctggcaggacctttccctatttgtacgcggcccggtgctattcgacctcaatcacaacttctgcaatgcctgggacaaaagcagcagctggatacgccgcgtgttcaagggcaccctgaaccacgagcgttcgtcgatcaaaccgctgagcctgattcgtgacggtggagagcccgcgcagatttgccggactcaaccggaagaaggcccggaaaaaaccattctcgaggtatatgaaaaggccctgggcaatgtgcatcagtacgcctatatcgagaaccaatacttccgctacaaaccgctggccgaacgcctgaagaaagttgccgccgactacgtcgctgccggcaaacaacaggacttgcacctgttcgtggtcaccaacaacccggagagcgggcatttctccagttccacctacgagatgctcgacacccttggccagggcgaactgatgcccctggcccaccgcgacctgctctacgatcaacgccagcttgcctatcgccagcgcgaactgaaggcccgcgacgaatcgccgacacgcgatcaggagctggccaaggtacagacgcaaatgcatgagcagggtatcgatccgagtcgcgccgatgaactcctggccatggaccccaacaaacactacaaccaggccgcggctcgcgaactggagccggagatgctgccgcccaaggggttgaaaatcattgtcgcgactctggtcagttgcaaggacggcggcgaaaccgctactcccaagacgcgcgagcagcgccagaccgaacgcgatatcaccgaacatctcggcccggaacaaggaatggcgcagtacaagtccatctatgtacacagcaagctgctgctggtggacgacctgtttttcaccctgggctccgccaacatcaacgagcgcagcctgaactccgactccgaactgaatatcgccatgccaagcccgcaaaccacccggacctggcgggagcggttgtgggggatgcattcggggaaagcaatcaatacgagcaaaagcagcttaagtgagaacgttgcattcgattatgaaaattgggagcaagtggtaactgataactggagaaatcagaagaaaaacttaccgcttaatggaaatttggtcagattttgggacgtggtgacaccttatgcaaaagcccttgattaaatatttatcttttttgttcttttgtttttttggagcagctatggctgatgaattcaagtgtgtccatgaaattaatacggctccccctcttgatcagcaagccgatcaatggtttaagcaggcaaggggtatgagtaaagagagacttcctgactgggtaaaaattgctggtctctatcagcaagcagtagataaagaccattggaaagcaatgcataacttagcagagctatacctccgtggtgatggcgtaaccaaaaatacaaataaagccatcgatctatatttgcatatggtcaaactacaagttccggtgggttattatgatatgagtgtgatgactcagagaggtgttggggtagttcagtcaaatagagatgccatgaattttttgctcaaggcgggtgacttgggtagcccgctagcccagactaggctgggtaatatatatatatgaattaaataaagataagctcggcgagtcttatctgcgttgcgcggcacatcagaatgacgccgaggcgaattacgaacttgccgcatactataaagtagtagacaaaaattaccctgtcgccatgcattattatcaaaatgctgcggctctaggtttgaaaaaaggctcgttgttaattgaaaatactttcagggatggcgactttgggtatgtgagaaatgaaaaaatagcaaatacctacagtgatatttctagtcggctatataaagatcctgatctccgatttcctaatttggccaaagaccatccacttccaccgcaccctattcagggctatcacgccgacaaagacatcaactggaaaccgaccggacgtgatgacgactattaaagcactgttggctgttgtgctattgggcggtagtggcttttccatggcatacgatttcaagtgtgttcatgaaaaagatattgctccacccctggaccagcaagcagactaatggtttaaacaagctcgggtgcttagcaaagagcgtccggctgattggagcaaagtggccagcctgtaccagcaggctgtagaaaagaaccattggaaagcaatgcacaatcttgcagagctatacttacgtggtgatgggcttgttaaggatacgaacaaggctattgatttgtatctggaaatgatcaagctacaggtaccgctgggttattacgatatgagtgtaatgaccaaaagaggcgtcggtgtggtgcagtctgataagcagtcagtaatatatttgctcaaggcgggagatgtaggtagtcctatggctcaagtcaggttagggaatatctatatttatgaggccaagaaaagagatctgggggtttcctacctacgctgtgctgcagatcagaacgatgcaagcgcaaattatgagttggccacatactacgagatcttggatagaaactaccctgttgccttgcattattatcaaagagctgcagctctaggtgaacggaaaggagccatggaaatagaaaatgtatttcaaaatggtaagttttcttataataaagacaagaagactgaaggtgcatactacaaagtgtccagggagctagccaacaatccagacttgcgcttccccaatctggccaaagaccacccactgccaccgaaccctgtgcagggctatcacgccgataaagacatcaactggagaccaaccggacgtgatgacgactattaagagaaagccaatagcgagaaacatcccgaaaaaatagcttcaacgagcctatgcgaagtatcaacgcgcgacttatgggccatcccgatgaaggagccgcacaatgcataaaatattcacggtactggcgatcgtgctgctagcgatctcgatactcagcgctttgctcgggctggctggcattgctagtggggcaagcggcagtgggggcatttccgattccgttgacgttgcgttcctgattgccaaagtgctgctcgccttgagcctgttgtctggagtgctggctattgcctggcccaggagcgggtgaagccaggtctggtttaaggattcacagggttatgaacaggtctctgcgtgtcggactcattaaggcagccgataaatgagtgtgacttggcagtcataatccccaataacgcactcatcttcccttaacattgcataactgtggcgttcccctccgaagccgctacactgcgccagccgttcatttttcctttggggctttgcgcatgaaatttcgttttctgctgtggatgatggggctgttgatgggcaaggccagccggaccaatcctgcgttccagcagcagttgggtgacaaggaactggtgttccagctgcagacgctggatggcaaggtggcgcggcatttccgggtgaaggatcagcggattaccagtaagccgggtgtgtatcccgagccggcgtttgccattgccttcaaggatgcggcctatggttttgccacgatgcaggcgaagaacaagcaattggcctttatgaccggaatccaggacaagtcgatccagatcaagggcaacccggcgctggtaatctggttccaggggctgaccaagtacctgaggccgaagaaggccaagccgaaggcttgaaggcgagcggtataccagccggaagatgattgcgggcaagcctcgctcctacgggagcggggcttttttctgggtgtcagtgctgactgaactgcgaggccagttcgcgcagcagcacttcggcttcgaggactttgctgaccacgtcttcggctttgtcgcgggacaggccgaggcgttcgagcagggcgtcagggatgtcttcgacggggccggagccgatgccgcggctgcgcagcagacgcacggccaggcacaccaggttcgggtattcggcgtaggcgccgtcgtagctcgggtcgtgctggaagcgcagggcggtggacaactcgtccggcatgtcccagtagcgcatcagccaggcgccgatctgttcgcggctgatgcccagcaggtgctgttcgacgtagctgtggcacaggtgcgggttgacctccaggtggcggcagatcagcgagaagtgcggcgggaagacgtgggccagcagcaggtagccgaagttgtgcagcaggccggcgaggtaggtcaggccggcttccgggcgctgggcacgcggcatggcgcgggtcaggccttcgatgacggcggcggtatagatcgactgctgccagtacggcgtgctgtgttgcgggtggtccttgggcaggctcagggtcttgcccagggccaggcccagcgccaggttgatcaccaggtcgaagcccagcacgcggacgatggcgtcttccaccgagcgtattttgcctggcgaggcgtagtagggcgaagccgcccagctcaccacttgcgcggccagggccgggtcggtttccaccacgccggtgatgtcgtcgatggtggcgttggggtcgacccgcagcttgatgatcttttgcgcggtttcggccagcggcggaatctcgatggtcgcttccaggcgttgctggatgcgccgggcggtgaaggcctgcattgcctgggtaatttcctcgcggtcgtcgtccgggcggtcgaggttcgggcggatgctgctcagggcctcgccgaaattgccggtgctggccttgctcagcatgctcttgaaggcgtcgctggtgatttccagcagcaggcccggctcgccggagttgatcagcagggtcggctcgcgcagcaggctttcttcatacaggcagggcgagctggtgagcgccggcaggccgggcagcaggctcaggttgtgtttgccgagcatgcgctccaggcgttccgtggagacggcggtcaggcggcggccggtcagttcggcgaggcgattgaggtccagcaactggctctgtgggaacagcaccatcagcgcaccgacggcgtcgtccagcaggacggcctgtaccttgcgcgcggccggcaggccaggatggtcgaggacttccgtgaagccgatgttcagcttgccgagcagcagccggattacagacggagcgtgcggggctgcggtggcgagggcaacttctgtcatggtctgtatccgttttcaaacaatttcaggagtataaccagcttgatcggggcattcgccccttaactgagacgctgctcacacttggccgtattgctgcccgtggcgcagccagcgctccagcagcgggctgacgtggtgcggccagcgctcgagcaaggcctgggcggcatcgcgcacggccggcagcaggtcggcatcgcgcatcaggtcggcgaccttgaattgcagcaggccggtctggcgggtaccgagcatctcgccggggccgcgcagttccaggtccttttcggcgatgacaaaaccgtcgttggtttcgcgcatgatgcccaggcgctggcggccgatctgcgacaagggaggatggtagagcatgacgcaatggctggcggcgctgccccgaccaacgcgaccgcgcagctggtgcagctgggccaggcccaggcgctcggggttctcgatgatcatcaggctggcgttgggcacatcgacgccgacttcgatcacggtggtggccaccagcagctgcaactcaccggctttgaactggcccatgacttcggccttttccgtcggcttcatgcgcccgtggatcaggccgacccgcagttcgcccagggcgctgctcaggtcttcgtaagtggtttgcgcggcctggcaggtcagctcttcggattcctcgatcagcgtgcacacccaataggcctggcgcccttcggcgcaggcggcgcgcacccgctcgatgacttcgacccgccgcgagtcggtcaccagcacggtgttcaccggcgtacggccagggggcagctcgtcgaggatcgaggtgtccaggtcggcgtaggcgctcatcgccagggtccgtggaatcggtgtggcggtcatgatcagctggtgcgggcacaggcgtccgcccacgcctttctgacgcagggccaggcgctgctgtacgccgaagcggtgttgttcgtcgatgatcaccagcgccaggttcttgaactgcacttcgtcctggaacagcgcatgggtgccgaccaccattggtgccccggcggcgatctgttccagggcggctgtgcggttcttgcccttgagcttgccggccaaccaggcgacttccagccccagcggttcgagccagcgcttgaaggtgatgaagtgctgctcggcgaggatctcggtcggcgccatcagcgccacctgatagccagcctccagcgcctgcagggcggcgagggcggcgaccacggtcttgccggcccccacgtcgccctggatcagccgcagcatcggctcgggctggctgaggtcgtaggcgatctcgttgccgacccgttgctgtgcgccggtgggcgcaaagccgaggttcttcaggtacagcgccggtagccgggtggccttgggcagcgccggggcgagttgcgagcgcaggctttcgcgcagacgctgctgggacagctgatgggtcagcagctcctcgaacgccaggcgatgctgggcccaatggtgtcccagggccagttcgtcgacatcggcgtcggccggcgggtgatgcaggtaacgaatcgcatcgtccagcggcgccagctggtaatcccgcgccagctcttgcggcagccagtccggcagactgcgcgggccgagcagggccaggctctgctggcacagcatgcgcaggcgctgctgggtcaggccttcggtgagcgggtaaatgggggtcagggtctggtccacgggcggcggttcatcgccgctgatggcacggtattccgggtggtagatttccagccccgacgcacctgggcgggcttcgccataacagcgcacgcgggtgccacgcttgaggccttccttctgcgcgttgctgaaatggtagaagcgcaggctgagcccgccggtgccgtcctgcaggcgcaccagcaggctgcggcgcttgcccatcaccacgtcggcgccgctgacggtgccttcgatcaccgcgtcctgcccggggcgcagcgcgccgatcggcaccacgcgggtacggtcctgatagcgcaggggcaggtggaacagtacgtcctgcaggttctccaggccgaccttggccagcttctcggccatggcttcgccgacgcccttgagtgccgtgaccggcatgttcgacagctcagtcatcgcgacggcttagctcgcggcaggcggcttggccaccgaacacaggcggatcgagtcggcgaggatctcgatggctttcggccgcgggaagctggcgcgccaggcgatcgccacggtgcggaacggcacgggcgcggtcagcggccgcacttcgatcacgcccggagcgtagtgatggctgtccaccgccgagagcggcaggatcgagacgccaaggccggaagcgaccatatggcggatggtttccagggagctggattccaccgtggtgtgcttggcaccgtcgttgcccttggtcagggtcgggcaggcttccaggacctgatcgcggaagcagtggccttcgcccagcagcaacaggctcttgtcgttgagcaggttggcgtcgatggtctctttctgggtccaggggtgggtgcttggcatcagcacgtagaagggttcgtcgtacagcggcagggtcagcacgtcggcttcgttgaacggcagggcgatgatgatcgcatccagttcgccgttgcgcagcttgtcgcgcagcacgtgggtgaagttttcttcgatgtacaacggcatctgcggggcgacccggtgcagttgcgggatcaggtgcgggaacaggtacgggccgacggtgtagatggcgccgaccttcagcggggcggtcagctggttcttgccggcctgggccagttcgcgaatgccctgggcctgttcgaggaccttttgcgcctgggcgacaatgccttcgccgaccggcgtcagacgtaccgcactcttgctgcgctcgaaaatcagcacaccgagttcgtcttcaagcttcttcacgcccaccgacagggtcggctggctgacatggcaacgctcggccgcgtggccgaagtgctgctcttgggcgagggtaacgatgtagcgtaattcagtaagagtcatagcggacgtccatgaggttgcgggccaagcataccggctgcaatcgatagacgcacgttatcagactcaatgctcgctgtgacaccgggcaatgcatgccggtcatgcctggaaaagcaaaaaggcacctttgggtgcctttttgctggggattgcctgggcatcatgctcagcggcgacgtttctccagggagtaaacgaagggcgcgacaatctcgatcgagccgttgttgagcatgtccgccggtggcttgggcagcggctgggcgcggcggatcatttccagggtagcccggtccagatcggcgttgcccgagcgtcctaccagttcataggacagcacgttgccttgggcgtcgaccacgaagcgcagccggttcaggccttccttgccgcgtgcctgggcacccggcgggtacttcttgtacttggccaggtgcgccagcagcgtgccttgccagctttccttggcggcgatctgcgccggcgacgggcccggagcaggtgccgaggacggtgccgcggtgggcgtcggcggagcgtcgctgggcttctcttcgctcggcttttccttcggcggttccggctttttctccaccggcttgggcggttgcggcttgggcttgggtttgaccggcttgggcacggaaatcgtcggcttcggcgcttccgcgagtttgggcagcggcagctcttcgaccggagccggcggctgcggtggcgtcacgaccttgggcggcgcgggaggaggcggtgccggaagcggcgccaactcgaccatcatcgcctgcggtggcagctcgaccggcatgggggagctccagttgagcgcgagcaggatcgcgaccgcatggacccccagtacgatggccaggctaccgctgtaacgcgtcagtttttggcgcgtcgtgatcatttcttggtagccgtctcaagtccgaccaggccgaccttcaggtatccggcggcccgcagggcatccatcacgctcatcaggtcgccgtaatccacgcctttgtcggcctggaagaagatcgtcgtgtcttttttgccctgggtcttggcgtcgagggtggcgccgagggcttcggccttcacttcgtcgtcgccgaggtacaggcgttggtcggccttgacgctgagaaacaccggtttctcggggcgtggtgccggtttggccgtcgaggccggaagatcgaccttgatatccacggtagccagcggcgccgcgaccatgaagatgatcagcagtaccagcatcacgtcgatgaacggcgtgacgttgatttcgtggttttcggcgagatcgtcttctgcgccttctttcaaatgcaggcccatggcggattaccctactttggccacatgaggttgcgcagagcgctcggcggtcggcaggtgatcgagatcacggctgaccagcagcaggacttccgcggaagcgtcggagacctgggccttgtagccggcgatggagcgggcgaagacgttgtagatgaccaccgccggaatggccgcgaccagacccagggcggttgccagcagggcttcggcgataccgggggcgacaacggcgaggttggtggtctgggttttggcgatgccgatgaagctgttcatgatgccccacacggtaccgaacaggccgacgaagggcgcggtggaaccgatggtggcgagcacgccggtgccgctgctcatgttgcggccgcaggcggctaccaggcgctcgaggcggaagctgacgcgctccttgattccttctttctcgcggctgttggccgacaggcgcatttcttccagggcgtcgtggaccagcaggttggccagggtgccttctttggcggcggtgacgctggcttccttgagggtggtggcctttttcaggttgaggatttcaccgcgcaggcgacgcttggcgcccatcagctcgaagcctttggcgatccagatggtccaggtgatgatcgaggcgatggccaggccgatcattaccagcttcacgatgatgtcggcgttctggtacatgccccacggggacaggtcgtgggccatgcccagggagttgtccgcttcgaggacttcaggtgcatcgccggctggttcgccttcggcaggtgccggcgctgcagcgactggagtggctaccggcgccgtggcgtcggccggcgcgtgggctgccgcaggtgtcgcggcgccagccggggcctgctcatcggcgaaggccgcggtcggtgccagcagcaggctgaacagcaacgctgcggccgcgctcatggcgcgcagcgggcttgggcgttgggttggcgaagcggagaattgattgcgtgtcatgctggccggacctgagagggaaaaaggtaagtgtccttctaggcctcgcagggccgagaacaaatgggccgtcattattgcaactaattcttgttaacagaagtaatagagtatctttttttctttgattgctagccgctcgtccattgccgacgctagtctgtgcctttctgataggagttttctgatgtccgccccttctgttctgatcgctggctgcggtgatgtcggcagccgtctggcgaagcaactgctggctgaaaactggcaggtctacggcctgcggcgcacggtttcgcaattgccggaaggggtgatcggtgtggcgggcgatcttttcagtgagcagtgtccgtcagcctggcccaccacaccgctggattacctggtgtacagcgcggccgccaccgagcatgacgaggcgggctatcgtgcggcctatgtcgaggggctgacccatgtcctgggttggctcaaacagaacggacagtcgccgaaacgcctgctgtttgtttccagcagcagcgtatacgggcagaaagacggcgagtggatcgacgagacctcgctggcccaggctgacggctattccgggcggctgatgctcgaggccgagcaagtggccttgcagagtggcattccagccagcctggtgcggttgaccgggatttacggcccggggcgggaatggctgttgaatcaggtgcgtcagggttatcgcgtcgccatcgatccaccgctgtatggcaaccgcattcatgccgacgatgccgcggggttgctggccttcctgttgcaggccgatcggcgcggcgtggtgcttgaggattgctatatcggggtcgatgatgcaccggtgcctttggccgaggtggtgggctggctgcgggagtacctgggcgtgaccgagtgggcggacagctcgagcgtgcggcgttccggcagcaagcgctgcagcaatgcccgcgccagggccctgggctgggcgccgcgttattcgagttttcgcgaggggtatgcgcagattatcgaagggcagggctgagccgcatcatggataaagaaaaaggagcctttcggctcctttttgctgggtcactgtttttccagtagccactggcgcgtacccggggtgagggaaggtacctcgttcgcctgggaggcgttgatgggctggaagatctccagttgcttgccgttgcgcgcaaagatccacgggttgccctggccgttgagctgcagccacaggttgtcgtagccgccgctcatcgaagcgcagtcgccggcgaggcacagtgcgtagcgatcggcgcccggcaggcccatgacctggccgttggactggaacagcacggtgccgccttcgcccgggccgttgacgattttccattcgccgcccaggtaagccgagtacagcgcgcgctcgaagttggcgcccagtggcgcgccttccggggccgggtccttgggacgatcgaagacctgctccggctcgttgtcgttggcttcttgcagcagctgtttgccgtcgcgtttcaactcgctggcggagctgccgtagaaatcgattttccaggcgccggactcttcagccagcaccttgccttcgacgttttcgaagccgttggtatagcgcgcctggctggccttggtgttgacgtcccactccaggttcgggccgtggccttgcagggcttcgcgcagcggtccgcctttggcggcggcgtcgatggcgacctggttgatccaggtaccactgatgtcacggtcggcgggatcgctggcgcagccaccgaggaacagggcgcacaacgagagggctagcgctttgcgcatgaggaaatcctttcagaacggagacggcgcggcctgggtagccgcgccggacgtgttactcgatgaccaggatggcatccatttcaacctgcgcgccttttggcagggcggcaacgccgatggcggcgcgggcagggtaaggctgctggaagtacttgcccatgatctcgttgaccttggcgaagtggctcaggtcggtgaggaagatgttgagtttgacgatgtccttgaacgaaccaccggcggcctcggccacggacttgaggttctcgaatacctggacggtctgggcttcgaagccttccaccagttccatggtctttggatcgagcgggatctggccggacatgtagacggtgttgcctgctttgatcgcctgggagtaggtgccgatcgcggcgggtgccttgtcgctggtgataacggtcttggtcatgaatgactccttgtaatgggcgggctatatagcgagctatgcacgcatgcgagtgatgcgaatgaccccggtcagggcgcgcagtttcttgatcacgcgagccaggtgcacgcggtcgtgcacgctgaccaccagttggaccacgctgatgcgaccatcccgttcgtccatgctgattttctcgatattgccgtcggccgcgttgacgctgctggccagcagcgcgatcaggccgcgctggtgttccagttcgacgcgcagctcgacgttgaattcgccggtgacatccttggcccacgaaagctggatgcatttttccgggttgtggcggatttcgctgatgttgcggcagttgtccaggtgcaccaccatccccttgcccgcggacaggtggccgacaatcggatcgcccgggattggcgtgcagcacttggcgtagctcaggaccaggccttcggtgccgcgaatggccagcggaccttccgggcttggcagctgttcgccttcgccgagcaggcgacgggcgaccacataagccatgcgattgcccaggccgatgtcttccagcaggtcttcgatcagctccaggcgatactcggtgagcatcgcttgcacgcgttcggcggggatcttttccagcgcgctgtcgaaaccgttgagcaccttgttcagcaggcgttcgcccaggctgatggactcggagcggcgttgcagtttcagggcgtggcgaatgtgggtgcgagccttgccggtgaccacgaagttgagccaggccgggttggggcgggcgcccggggcgctgacgatttccacggtggagccgctttgcagcggttcggacagcggcgccagacggcgattgatacgacaggcgatgcagctgttgccgacgtcggtgtgcaccgcgtaggcgaagtccactgcggtggagcctttgggcagctccatgatccggcccttcggcgtgaacacgtagacctcgtccgggaacaggtcgatcttcacgctctcgatgaactccagggagttgccggcgcgttgctgcatctccagcacgcccttgacccactgacgagcccgggcatgggtgccctttggctgctcgtcgccgctggatttgtacagccagtgggcggcgatgccgttgttggccatctcttccatttcgcgggtgcggatctggatctcgatcggcacgccgtgcatgccgaacagcgtggtgtgcagcgactggtagccgttggccttgggaatcgcgatgtaatccttgaagcggcccggcagcggcttgtacaggttgtgtacggcgccaagcacgcggtagcaggtgtcgaccttgtcgacgatgatccggaacgcgtagacgtccatgatctcgttgaaggcccggcgtttgccgcgcatctttttatagatgccatacaagtgcttctggcggccgctgacttcgccctggatgccgtcgatggccaggcagtggctcagggattcttcgatcttattgacgatttccttgcggttgccccgggcgcgcttgaccgcctggtagatccgcgcggaacgcatcggatgcatggccttgaaaccgaggtcttcgaattcgatgcggatgctgtgcatgcccaggcggttggcgatgggcgcatagatctccagggtttccttggcgatccgccggcgtttttcaccggacagcacttccagggtgcgcatgttgtgcaggcggtcggccagcttgaccaggatcacgcgaatgtcgcgcgccatggccatggccatcttctggaagttttccgcttgggcttcggccttggtctcgaaattcatctgggtcagtttgctgaccccgtcgaccagttcggccacggtttcaccgaactgcgcttgcagcgcttccttggcgataccggtgtcttcgatcacgtcatgcagcatggccgccatcaggctctgatggtccatatgcatgtcggcgagaatgtttgcgaccgctaatgggtgtgtgacgtacgcctcgccgctacgacggcgctgaccgtcatgggcttgttcggcgtagaaatacgctcggcggaccagattgacctggtccgtgccgagataggtcgataagcgatcggcgagggcgtctatgctcggcatgatgactcctgccgtaggctgtgatcccgcgccgtgctacgtcgaccaggcataggcttagacggcctcgttggactcgtcctcgaatgcagcaaaaagcggttcatcttcaacgatttcggcttcggcgatagctgcgtagtcgatcaggccttcagcgatttcacgcagggcgacgacggtaggcttgtcgttttcccatgctactttcggctctttgccgccggttgccagttgacgggcacgcttggtagagagcatgaccagctcaaagcggttatccacgtgttctagacagtcttcaacggttacgcgggccatggtcttcctcgtagcaaatgcaatatgcgcgctgcccggatgggcgagcggactcaacagtttaaaaaatcaccagcgattagggaagcgctgattttttaaccaagctttccgacgcgctacaagcgccaatgtaaagcccttgcagcggttttgggaagtgctattcagcccagcaattcggcgagcaatttgccgaaacgctgttgctgatgcttctggtgcagctggttggtgcggaaaatcgccttcaggtcgtccagcgcatgggcgaaatcgtcgttgatgatcaggtagtcgtagtcgacgtagtggctcatttcgctgacggcttcgcgcatccggccttcgatgatctcgtcgctgtcctggccgcggttggtcaggcgctggcgcaaggcctgctgggacggcggcaggatgaagatcgaacgagcctggggcatcagcttgcgtacttgctcggcaccttgccagtcgatctccaggatcaggtcgtgaccttcgtccagggtctgctgcaagtggctttgggaggtgccatagagattgccgaagacttcggcacgctcgaggaagtcgccgtgctcgcccatcttcacgaatgcttcgcgggagacgaagtggtagttcacgccgtccacttcgcccgggcgcatggcgcgggtggtgtgggaaacggaaacgcggatcgacgggtcggcgtcgatcagcgccttgaccaggctggtcttgcccgcgcccgagggtgcggaaatgatgtagagggtgccggtgctgtggttcatgtctgggtagccttactcaatattctgtacttgttcgcgcatctgctcgatcaacaccttgaggttgaccgcagcctgggtgctgcgcgggtcgaaggccttggagcccagtgtgttggcttcgcggttgagttcctgcatcaggaagtccaggcgccggccggccgcgccgccggacttgagcacgcggcgaacttcgatgatgtgggtgctcaggcggtccagttcttcggcgacgtcgctcttctgggcgagcagtaccatttcctgttccaggcgcgtcgggtccagctcggcctgcatgtcggcgaagcgatcgagaaccttctggcgctgggtggcgagcatctgcgggaccagttcacgcagggtcatgacgtcttcctcgatggaggtcaggcgttcgttgatcagccgggccagctccgcgccttcgcgctcgcggccgctcttcagctctttcagcccctggttgaacaggctcagggcttcgttgttcagcgcctgcgggtcgctggcatcggccaccagaacgccgggccaggccagcacttccagtgggttcagcgccgccggctgcttgatcaggctggcaacggactcggctgccgccaccagttgcgcggcgcgctcccggtcgacctgcagtggtttgccggtggtttcttcggtgaagcgcaaggtgcattcaagcttgccgcgcgacagtccctggcgcagcgcctcgcggaccgagccttccagatcgcgaaaggattccggcaagcgcaggtgcggttccaggtaacggctgttgaccgagcgcagttcccaactcagggtgccctgggtgccggcccgttctacccgggcgaaggcggtcatgctgtgcaccatggaggtacctccgatacaggtccgccgccaaccgcggagggttgcacgggcccgatatgaatgaattgaagccgacaggctgcgaaggcgcaggattgtagcgcagtgcggtggatgctcccaaactgcgggtgtgacaaaccgctgcggggcgaccggagggccgttccagaggcgtcgccgatggggcggggtttttagaactgcccaggcagggccgcgggctctataatgatcggcagttttccgtccccgtacaggtatttccctatgaaacgtccaagtggtcgcgctgccgatcagctccgctcgatccgcatcacccgcaactacaccaaacacgccgagggatctgtactggtcgagttcggtgataccaaagtgatctgcacggtcagcgtcgagaacggcgtgccccgcttcctcaagggccagggccagggttggttgaccgccgaatacggcatgctgccgcgcgccaccggcgagcgtaaccagcgtgaagccagtcgcggcaagcaaggcggccgcaccctggagatccagcgtctgatcggccgttccctgcgcgctgcgctggacatgaccaagctgggcgatgtcaccctgtatgtcgactgcgatgtgatccaggccgatggcggtacccgtaccgcgtcgatcaccggtgccatggtggctctggtggatgcgctgaaagtgatcaagaagcgtggcggcctgaagggcggcgacccgatcaagcaaatgatcgcggcggtgtccgtgggcatgtaccagggcgagccggtgctggatctggattacctggaggactcggcggccgagactgacctcaatgtggtcatgaccagcactggcggtttcatcgaagtccagggcactgccgaaggcgcgccgttccagccggaagaactgaacgccatgctggcgctggccaagaaaggcatgagcgagatctttgaattgcaacaggcagccctggctgactgattgcccggtagctttcagcaaggagagccgcatgaacgacgaccagcttccgcaacctgtcccgagccatgaggtgcgtcagtgggcgatgttctgtcacctgtcggccttgctgggcatctggattccgttcggcaccctgatcggtccgttggtgctctggcagatgaagcgcgagaccgatccgttcatcgatgcccagggcaaggaagcgctgaactttcagatcacggtggcccttgcctcgctggtctgcttcctgctgatggtggtgctggtgggtttcctgcttttcggtctgctggcgatcggcgccctggtgctgaccatcatcgccggggtcaaggccaatgaaggggtggcgtaccgttacccgttcacctggcgattgatcaagtaggccgggcgtccacaaaaaagccgacagtgatgtcggcttttttgtggctgcgaaaagacgcttagatggtcagcgtccagtcgtagtccacgatcagcggtgcgtgctgcgagaagcgcggctggcgtggcaggcgtgcgctgcgcacgaagcgacgcaggcccggggtcagcaactgatagtcgaagcgccagcccaggttgagcatctcggcctgttcgttgtccggccaccagctgtattgatcgccttcgcggctgacttcgcgcagggcgtcgacataacccatgttgccgacaatctcgtccatccaggcacgctcaggcgccaggaaacccggagattgttggctgtcacgccagttcttgatatccagcttctgttgcgccacgtacagcgagccacaataaatgtactcgcgacgtttgcgccgctgtttatccaggtaacgggcgaagtcgtccataagcttgaacttctggttcaagtcttcatcgccgttctgcccggaaggaagcagcaaggtcgcgatgctgaccttgtcgaaatcggcttgcaggtagcgcccgtagcggtcggccgtctcgaagccgagaccgctgatgacagccttcggttgcaaccgcgaatacaaagccacaccgccttgggcgggaacttcggcatcgcaggcataaaggaagtagccatccagttggaaggctggatcgtccagttcaaaggcggaggcgcgggtgtcctgcaggcagatgacgtcggcattctgtgcttgcagccaactgagcaaacctcgctccaccgcagcctgaataccattgacgttcacactgatgatccgcataaatggccccaaaaatcacgtgcgtgtatgatacccgaggtctacctaattagctaaatccgtggtatttggggctttttcatgcaggcgtatcagcgcgatttcattcgttttgccatcgatcgcggggttttgcgcttcggtgagttcaccctgaagtccgggcgtaccagtccttacttctttaatgccggcctgttcaacagcggttcggccctggcgcagctggggcgtttttatgccgcggcgatcgtcgacagcggcatttctttcgatgtgcttttcggtcctgcgtacaaaggcattcctttggcggcggcgacggccgtggccctggccgagcatcatcagcgcgatctgccatggtgtttcaaccgcaaggaagccaaggctcacggcgaaggcggcagcctggttggcgcgccattgactggcgacgtgctgatcatcgacgacgtgatcaccgcgggcacggcgatccgcgaagtgatgcagataatcgaatcccaggaaggcgccaaggcggcgggtgtgttgatcgccctgaaccgccaggagcgtggcaatggcgagctgtcggcgatccaggaagtcgagcgcgacttcggcattccggtggtgagcatcgtttccctgacccaggtcctgcagttcctggcggacgatccggcgctcaagcagcatctgccggcggtggaagcctaccgcgcgcaattcggcgtctgataccgacttgtagggatcgcacaggcaaaaaaagaccccgctcagccaggctgaacggggtctttttatttgcagagcttaaggacgcttgcgattgctgatcagggtaccgacaccggtatcggtgaagatctccagcagaatcgcattgggtacgcgaccgtcgatgatcaacgagctgcccacgccaccctgtaccgcttccagcgcgcagcgaatcttcggcagcatgccgccgtagatggtgccgtcttcgatcagggcatcgacctgctgggtggtcaggccggtcagcaccttgcccgacttgtccatcaggccggcgatgttggtcagcagcatcagcttctcggctttcagcgcctcggccaccttgccggccaccaggtcggcgttgatgttgtacgactcgccgttggcgccgacgccgatcggcgcgatcaccgggatgaagtcacctttgaccagcaggttcagcagatcggtgttgatgccgaccacttcgcctacgtggccgatgtcgatgatttccggggtggtcatttccggcgtcttgcgggtgacggtgagcttcttcgcgcgaatcagctccgcgtccttgccggtcaggccgatggcgctgccgccatggcggttgatcaggttgacgatgtccttgttcacctggccgccgaggaccatctccaccacgtccatggtcgccgcgtcggtgacgcgcataccatcgatgaagtggctttcgatggacaggcgcttgagcaggtcaccgatttgcgggccgccgccatgcacgaccaccgggttgatcccgacagccttcatcagcacgatgtcgcgggcgaagccggtcttcagctcctcgctttccatcgcgttgccgccgtatttgatcaccagggtcttgccgacatagcggcgaatataaggcagcgcttcggacaggaccttggcggtattggcggcggcatcgcgttcgagggtcattcagggctccggcacttcaataaaggcgcttgaagaaaatcaaaacggtagttggaggtcaggtgcaacacgtttcagctgggtgtggaacacatccttgatgcgctgcagttcggcttcgtcatcggcctcgaaacgcagtaccagcaccggcgtggtgttggaggcgcgaaccaggccccagcctttggggtagtcgactcgtacgccgtcgatggtggtcaggtcggcgccttcaccccattgggcatcgtgcagcgcatcaatgatgctgaatttgctctcttcggtcacatggatattgatttccggcgtagaaatatcgttcgggaaggtggcaaatagctcttgcgcgttggatttttccttgctgaggatctccagcagccgcgcggcgctgtagataccgtcgtcgaaaccgaaccagcgttccttgaagaacacatgcccgctcatttcaccggccagcaacgcaccggtctgcttcattttctttttgatcagcgagtgaccggtcttccacatgagtgggcgaccaccgtattccttgatcagcgggatcaggcggcgggtgcatttgacgtcgaagatgatctccgcgtccgggttgcgcgctacgacatccttggcgaacagcatcaacaggcgatcggggaagacgatgctgccggtgttggtcacgacgccaacgcggtcgccgtcaccgtcgaaggccaggccgatatcggcgttggtctcggcgaccttggcgatcaggtcttccaggttctccggcttgcccgggtccgggtggtggttggggaagttgccgtccacttcgcagaacagcgggatgacttcgcagttcagcgcttcgatcagctgaggcgcgatgacgccggccgcgccgttgccgcaatcgaccacgactttcaggcggcggacgagtttgatgtcctgaacgatttcagtgttgtagcgatcgaggatgtcgaccttggtgatgctgccctggccactgctcaggttgttggtcttgaggcgatcgtgcagggcctggatctgttcgttggccagggtgtcgccggcaatgacgatcttgaagccgttgtagttcgacgggttgtggctaccggtcagcatcaccccggatttgccggccagcacattggctgcgtaatacagtgccggtgtcggtaccaggccgacatcgctgacgtggcagccactgtcgtgcaggccctggatcagttgcgccaccagctcggggccggacaggcgaccgtcacggcctacgcaaacattgggttcgccctgggccaggctctcggagccaatggcgcggccgatccagtaggcggtttcagcgttcagggtttccggaacggttccgcgaatgtcataagcgcgaaagatgctttcagggaacttgggtacgacttgggctgcgttgctcatcactgggggtgctccgtctaaaagggggcaggacaggccggaatactgaccggaaggctcaaactgaagggtatgacggcgtttttgcccttgggttcatggtgcaaaaatgccatctgatgagcgtcagctctttttcgatcaccttgtgccgtgattccgggtggtcaagtccgcgaataaacctgctgagttttcgtgctgaaacacagcctaccaatcttaggcgagccgctggcgcggcccgctttttttgttcaatggctgccggagtgaccgaaaccgcccgcgccgcgctggctttcgtcgaaggcttcgaccacttcgaagtgcgcctggaccacgggtaccagaaccaactgggcaatgcgttcgcccaccgcgatgttgaaggcggtctgaccgcggttccagcaggagaccatgagttcgccctggtaatcggagtcgatcaggccgaccaggttgcccaggacgatgccgtgtttgtgacccaggccggagcgcggcaggatcagcgcggcaaggcctgggtcgccgatgtagacggataggccggtaggaatcagcagggtctggcccggttccaggagggtgtcctgcttgagcatggcgcgcaggtcgaggccggcggagcctggcgtggcgtactgcggcagggggaattcgttgccgatgcgtgggtcgaggatcttggcttgtaaagcgtgcatgcgagttaaacctggttcagccgttcggcgatgaaagagatcagttggcgggcaatcttgcccttgctggtctgggcgaagagagttgcgtgcaactcccggtcaatcacgctgcaggcattttcctcgctgttgaagccaatgctcgggttggccacgtcgttggcgacgatcaggtcgaggttcttgtctttgagtttgcgtgcagcgtagtcgagcaagtgttcggtttcagcggcgaagccgacgctgaacggacggtcggggcgggtggcgattgtggccaggatgtccgggttgcgcaccatctgcagtagcaggccgtcgccgtttgtagggtctttcttcagtttctgtggggcgacgacttccgggcggtagtccgcgaccgcggccgaggcgatgaacaggtcgcacgggatggcggcctcgcaggcagcgagcatgtcgcgggcgctgaccacgtcgatccgtgtcacgcgatccggggtcggcaggtgcacgggaccggtgatcagggttacccgggcaccggcttcgaccgcggcttcggccagggcaaagcccattttcccggagctgtggttggtgatgtagcgcaccgggtcaatgttttcctgggtcgggccggcggtgatcagcacgtgtttgccggtcagcgccaggtgctggaagcagtcggcggcgcacagcgccagatcgttggcttcgagcatgcggccgaggccgacgtcgccacaggcctggctgccggaagccgggccgaagaccttcaggccacggctttgcagcagctgggtgttggcctgggtggcagggtcgcgccacatggcctggttcatggccggggcgatggcgacggtggcgtcggtggccaggaccagggtggtcagcaggtcgtcggcgatgccttgggccaggcgggcgatcaggtcggcggtggccggggcgatcagcaccaggtcggcccatttggccagttcgatatggcccatggcggcttcggccgcggggtcgagcaggtccaggtggaccgggtgcccggacagggcctgcatggtcagcggggtgatgaattcactgccgccacgggtcatgaccacacgcacttccgcgccgtggtcgaggagtcggcgaaccagctcggcgctcttataggcagcgatgccgccgccgacgccgagaacgatgcgtttccgatacagccgctgcataggcctgcctttcagttcaatgattgctgcgtgtaacaccccctccccaggggaaattccacgcaaaaagatgggctaagatagcacagcgaccgctatggaacagcggcgcccacacacatggaggtgctatgagcattcgcgactggcctgcggcggagcgcccgcgggagaagcttctcgagcagggcgcgctggccctttccgacgccgaattgctggcgattttcctgcgcaccggggtcgccggaaaaagcgcggtcgacctggcgcgacacctgttgcatcagtttggcagcctgcgtggtctgctcgaggcggaccaattgaccttcagtcggcagcttggcctgggcccggccaagttcgcgcaattgcaggcggtgctggaaatggcgcgccggcatctggcggaaaaactcagtcgcaattcggtgctggaaagcccggtggcggtccgcgactacctcaaggcgatgttgcgccatgaaccgcatgaggtcttcggttgcctgttcctcgactccaagcaccgggtgctggcgttcgaggcgttgttccagggctccatcaacaccaccagcgtctatccgcggcaggtggtcaagcgtgccctggcgcacaacgcggcggcgctgatcctgtgtcacaaccatccttcgggtgtttccgaaccgagccaggcggatcgggtgctgacccgcaggctcacggaggcgctggacctggtggatgtgcgcgtactcgaccatttcatcgtcggcgagggtgagccgctgtcgatggccgagtacggttggatgtagccggggtcagggcttgaggctgaccttcgagtagtcctggcgaccgaacgggctgacctgatacccatggacatccttgcgcgtcagggcgaaggcggtcgggtgggcaagcggtagccacagagcctgctgctggatctgggtttgcgcctgctggtaaagcttgctgcgcacgccctgctcggtggtggtcttgccggcggtgatcagcttgtccaggccggggtcgcagtagcgggcgaagttggtcccggacttgactgccgcgcaggtgaactgcggggtgaggaagttatccggatcgccgttgtcgccggcccagcccatgaacagcaggtcgtgctcgccggccttggcccgacggatcagctcgccccattcgatcacgcggatctccgcctggatcccgacctccgccaggtccgcttgcagctgttgcgcgcccaggctcgggttggggttcagcaagctgccggaagggcgggtccagatcgtggtctggaaaccgtctttcaggccggccttggccagcagctggcgggctttcgcaggatcgtgggcgtaacccggcaactccttggcgtagctccaggtgttgggcgggaaggggccgttggcgggttcggcggtgttttcgaagaccgctttcaggtagttggccttatcgaaggcgaggttgatggcctggcgcacttcaggtttgtccagcggtgggtgctggctgttgatggcgacgaatgcggtcatgaaagctgcggttttctcgaccttgagcgcaggctcctcaagcgcggcgctcacgtccagcggcttgggcgacagggcgatctggcattcgttgcgacgcagcttctgcaggcgcacgttggcgtccggggtgatggcgaagatcagcgagtccaccgccggcttgccggcaaagtagtcggggttggccttgtagcggatcgatgcgtccttctggaaacggccgaaaacgaaggggccggtgccgatcggctggctgttgagcttgtcctgggtgccggtcttgagcaactggtcggcgtattcggcggagtagatcgacgcaaaccccatgctcagggtggcgaggaaggttgagtcggcgtggtcgagggtgaagcgcacggtcagtggatccagggcgtcgatcttcttgatcagcgccggcagctgtagcgactgggcatggggatagccgctctgcgccactttatgccagggggtggccgggtcgagcatgcggtcgaagctgaacttcacgtcttcggcggtcagctcgcggctcggattgaaatacgcggtgcgatgaaacttcactttcgggtgcagcttgaacacataggtcaggccgtcggccgagacttcccagctgtcggccaggctcggtaccaccttgccgctgctggcgtcgaactccaccaggcgattcatcagcacatcggccgatgcgttggtggtggtcagcgagttgtactgcactacgtcgaaaccttccgggctggcctcggtgcacacgcttaatgcggcggcgtgggccagcgggctcagaagaagaggggcgaacaggagcgggagggcagcgaggcgcatgtttggcttcctttgcagatcgaaggcccatctgcgagtgcagtctggaaaaggcttaccctagtggccccgttgaaaaatgactatccccttttttcgctcgtgggccggatacattggcatttattgcagcgtcgagcctgttggcggccggcagtcatggccacattaggcataaattgacagaggtttttttccatatattgacgtggaacgagcggtgcggcggctgtgcagggtgattttgccgcctgttttaccctcggagaatttattctgcgacgagcggtcagccatggcgccagcctttggtgcaggcatccggagcaagaaaacagggacttttcgaaatccaaagcacaccggctgttgttgctacggggtctttctggtataaagcagcgctcttttctaggggcccggttccttcgcttgtaggtgtagccggtaagaccctaaagaaacgcggcgcctggcgccaaatgactgagagattaagcggccaacccatgccgggttgggcatgtggttttagagggctgaggcatgtcgagagtctgtcaagttaccggtaagggtccggtgactgggaataacatttcccacgcaaacaacaaaacccgtcgtcgtttcctgccgaacctgcagcatcaccgcttctgggttgagtccgagaaacgttttgtgcgtctgcgcgtatctgccaaaggcatgcgtatcatcgacaagcgtggcattgatgtcgtgctggccgaacttcgtcgcgatggcaaggtttaagggagctaatcatgcgtgaattgattcgtttgatttcgagcgccggtactggtcacttctacactaccgacaagaacaagcgcactactccggacaaaatcgagatcaagaaatatgatccggttgttcgtaagcacgtgatctacaaggaaggcaaaatcaagtaattgatttttcttctgacaaaaaaacccgccttcaagcgggtttttttgtgcctgcgattcaggctttcggttcgaagatcacatagatcttgcggcacggctccagcacctcccaggtgccgcgaaagcccgcgggaatgacgaagcgatcgccggcgcgcaaggtcttggcattgccttcgccgtcacgcaggaccgaaaccccctgcacgatctcgcagtattcatgttcggtgtagttcaccgtccactggccgatcgcgccttcccataccccggcgttcatctggccgcacgggctgttgtagtggttgaagacggtctgctcagggtcacccttgaggactttttcctgggcggggcgataccgctcggccgcagtgttggcctgattgaagtcgacgatgtcctggatgctcatgctggtattcccccctgattgcgctgcgaatggctggaaagcccaaagtctatgtttattaaaatgaacatagcaatggcgtttgcctggccactgtcaaatatattgaaacttcgggtgccgctggtttagggtggcgaatgccatgggccgaagcaggctggccgggcagaattcctgaaggtgccggcatcgatcgcgtggcgcctgtatccaacaagaggaggacactcgcatgaccaccctgactcgagccgattgggaacaacgcgcccgcgagctgaaaatcgaaggccgcgcctatatcaatggcgaatacaccgccgccgtttccaacgaaaccttcgaatgcatcagcccggtcgatggccgtctgctggcgagtattgccagctgtgacgccgccgacgcacaacgcgccgtggaaaacgcccgcgccactttcaattccggtgtctggtcgcgcctggcgccggccaagcgcaaagccaccatgattcgttttgccggcctgctgaagcagcatgccgaagaactggccctgctcgaaaccctggacatgggcaagccgatcagcgactcgctgggtatcgacgttcccggcgcggcgcaagcgctgagctggagcggcgaagccatcgacaaaatctacgacgaagtcgccgccacgccccacgaccaactgggcctggtgactcgcgagccagtgggcgtggtcggcgccatcgtgccgtggaacttcccgttgatgatggcctgctggaaactcggtccggcgctgtccaccggtaactcggtgatcctcaaaccgtcggaaaaatcgccgctgaccgctattcgcatcgccgcgctggccgtcgaggctgggatcccggccggcgtgctcaacgtgctgccaggttatggccacaccgtaggcaaggccctggccctgcacatggacgtcgataccctggtgttcaccggttcgaccaagatcgccaagcaactgatggtctactccggcgagtcgaacatgaagcgcgtctggctggaggcgggcggcaagagcccaaacatcgtgttcgccgatgccccggacctgcaggccgcggccgaatccgcggccagcgccatcgccttcaaccagggcgaagtctgcaccgccggttcgcgcctgctggtggagcgttcgatcaaggataaattcctgccgctggtgatcgaggccctcaaggcctggaaaccgggcaacccgctggacccggccaccaacgtcggcgcgctggtggatacccagcagatgaacaccgtgctgtcgtacatcgagtccggtcatgccgacggcgccaagctggtggtgggcggcaagcgcaccctgcaggaaaccggcgggacctacgttgagccgaccatcttcgatggcgtcagcaacgcaatgaagatcgcccaggaagagatcttcggcccggtgctctcggtcatcgccttcgacaccgtggaagaagccatccagattgccaacgacacgccttatggcctggccgcggcggtatggacggccaatatctccaaggctcacctgaccgccaaggcgctgcgggccggcagtgtctgggtcaaccagtatgacggcggcgacatgaccgcgccgttcggcggcttcaagcagtcgggcaacggtcgcgacaagtcgctgcatgcgttcgacaagtacaccgaactgaaggcgacctggatcaagctgtaattcaaggggcgtggatgtcgggcgtctgaacagacgccatcgcgcgcaccgttagccggtccatatcgcagccggactttccgcatgggaggtccggctgcgttgtctctgtattaaaaaaacaatccacaggagcgtggaaatgcgctgggcaacgtatttcgccgttttggcggctgtcctgagtgtggggctggccttgggcgtgagcatgccgctggtgtcgttccgccttgagagttggggttatgggccctttgcaatcggcgtgatggcctcgatgccggcgattggcgtcttgctcggggcgaaggtttccagccgcctggcggcacgcttcggcacggcggggctgatgcgcctgtgcctatggggcggggcgatctccatcggcctgctggcgctattgccgagttatcccctgtggctggtgctgcggctgatgatcggcgtggtgctgaccatcgtcttcattcttggcgaaagctggatcaaccagttggtggtggagcagtggcgcggtcgcctggtggcgctgtatggcagtagctatgccttgagccaattggctggcccgctgctgctgggcgtcttgggcaccgagcatgactacggtttctgggtgggcgtcgtgctgctggtggtgtcgcctctgttgctgatgggccgcagcggcgcgccgagcagcgagtcttgcagcgtgaccttcggtgatctgtggcgcttctgtcgtggcctgccggccattggctgggcggtggcgctgttcgcagcgttcgaggcgatgatcctgaccctgctgccggtctattgcctgcgccaggggtttaccgaggacatcgccctggcgatggtcagcaccgttgtagtgggcgatgccttgttgcagctgcccatcggcgccctggccgatcgcgtatcgcggcgtgccttgttcgccggttgcgctgtggtcctgctgctgtcgagcctggccattcccttgctgctcgacaccctgctgatctggccgctgtgggtgctgttcggcgccagcgccggggggctgttcaccttgtcgttgattctgatcggcgaacgctaccgcgacgatgcgctggtgcgcgccaatgcccacgtctcccagctgtggggcatcggctgcctgatcgggccgctggtggcgggggcaggcagccagtggatcagcgggcatgccttgctgttgctgatggcggccggggccctggggctgattgtgctgttgttgcgcgaaggcgcgtttggcgcggcccaggcacaaaccctgtagggctggtctcagagcatccgttcgaggccgatggtattgctcatccaggcattgaagcgccgccaccagctgcccggctcgcgggtcagggtgtgcagttgctggttgtcttcggtgatccagaccagcttgccgtcctgcagcttcgcttcgtagctcagggccggcgccatgccttgcagcgccaggctgcgaacgtgttcggccagctcggggctgtccaccagcaccccgacttcggtgttccacagcaccgagcgcgggtcgaaattgaaggagccgataaaggacttctgacggtcgaagatgatcgccttgctgtgcaggctggagtccgagccaggatatgacgcgctatggaacagatgaggaccgctgccgccgccgttaccgggttggcgccgcagttcatagagtttcacgccgtgttgcagcagcgccttgcgatacggcgcgtagccgccgtggaccgccggcacgtcggtggcttccagggagttggtcagcaggctcaccgcaaccccggcgtcggcgcgtccggtgaggtagaccaggcctggctggccggggacgaaataggccgaaaccatcatcaactctttactgacgctctgtagctccggcgccaactgggtggtcaacagcaggtgcgggtcgggttcgcccttggacaggaccttgctcggggcgtcccacagcgcctggttccaggcccagatcagctctttgcgccagacgtccatgcgcggctgggtccgataggccttgagctcctggaacagggcatgctcctgctgctgggcgtcgtccagcgattgctgcaggcgcagccgggtgttggccagctcccgggccgatggcaggcgcgacataaactcgccgatgggtttgctcagggcgctgttccagtactggtcgaagctgtgcccgagctgttcggccaccgggccgataccgaggatgtcgatgtcggtgaagttcaggttgggttcggcgtcgaagtactcgtcccccaggttgcgcccgccgacgatggccgcgctgttgtccgccagccacagcttgttgtgcatccgccggtgttgcagcgacaggttgaacaggcgccccatggtacgggtcacgccggtgctgcgccccaggtgcagggggttgaacaggcggatctgtatccgcggatgggcggcgagggtggccatgatctggtccaggccgtcgctggtggtgtcgtccagcagaatgcggatgcgcacgccgcggtcggcggccttgagcagttcgtccaccagcatccgggtgctgatgccgtcatggacgatgtagtactgcaggtcgaggctgctttgggcgttgcggatcagctcggcgcgggccatgaaggcttcgctgctgtcggacagcaggcgaaagcccgagcgtccctggtagggggcggcctgggcctggattgagcgaccgaaggccgagtcggcggccggcagtgcctggctgggctcgtgaggcacatcgaggctgacgcagccgctcaggcacagcgcgatcagcataaggaaggccagggcctgtctggatctcaagtcagctcatctcgaatcgctgcgatggtctagctgtgacgccggtttcacaggaaaaggtcagtccgtggcgcaatcttcagccagcagcttgatggccgctgcgccgactttgcgcacggcttcctcgatctgtgccgttggcttggcagcgtagttcatccgcaggcaattgcggtacttgcccgaggccgaaaagatgctgcccacggcaatctgcacgccctggccgagcagcgcgcggttcaggcgcagggtatcgaaaccttccggcagttcgacccacagcatgaacccgccctgcggccggctggcgcgggtgccggtggggaaatagcggctgacccagtcgatcatcagatcgcgattgcgctggtactgggtgcgcatgcgccgcaggtgcggctcgaaattgccgctcttgaggaactcggcgatggcgatctgcggttgcggcgcggtggagccggtgctgatgtatttcatgtgcagcactcgttccagatagcgcccgggggcgacccagccgatgcgcaggcccggcgccagggtcttggagaaggagctgcacagcagcacccggccatcgtcatcgaacgacttgatggtccgcgggcgcggataggtgtaggacagctcgccatacacatcgtcttcgatgatcgccacgtcaaagcgctgggccagggtcagcagggcccgcttgcgcgactccggcatgatatagcccagcgggttgttgcagttcggggtcaactgtatggccttgatcggccattgctccagggccagttccagggcgtcgaggctgatgccggtgagtgggtcggtggggatttccagggccttcatgcccaggcccttgagggtctgcatggcgccgtggaagcttggcgagtcgacggcgacgatatccccaggctcgcaggtggcacggatgctggtggacaaggcttcgtggcagccggtggtgatcaccaggtcgttggcgccgagctggcagccggaatcgagcatcagccgcgccagctgttcacgcagttcgtgcacgccgtagatggtgtcgtaatacagaccgggcatgtcctggcgccggctgatgcgggcgagcccgcgcaacaggggcttgagggtcgggctggtgacgtcgggcataccgcggcccagctggacgatgtccttgcgcggcacactgcggatcagttccaacacctggtcccactgcgaaatctccactggccgctgcgccgggcgacctaccgcgggcagtgccggcagctcacgactgaccggcacgaaatagccggacttgggcttgggcgtcgccaggccgctgtcttccagcacccgataagcctgctgcacggtactcaggctgaccccgtgttcgacactcaaggcccgtaccgacggcagtcggtcaccggggcgatagaagccttgttcgatacgtgtgcccagcagttcggcgagattgacatacagggtcatggcgcagcctcggggtgattgaatcgggtaaccagtacagatggcgcaaaattacaggattcagcccggataggggaaattctgtatggaaataatagcagtgctttgaatctgtaatggtttctggcgcccgcgcatgatgtctgctcatagcgacccaagtaaacaggagcagcaaaaatgaacggcttgagcgatgtgcgtctgtcgttacacagtcaggaactggcggctgggcaggagcgggcagcaggggcgatgtccgtccacaatgcgccgtccggcctcggtctctggggcctgtactggcaccgactgcgtacacgcaaggcgctgctcgagctgaccaccgaacagttgcgcgatatcggcctgagtcgcgaacaggcccggcaggaagggctcaagccgttctggcggctgtagccgctggcgcagtctgcgatcggttgcgtagcaatcgcaaaaaggccgcatccgatttccccggatgcggcctttttcatgcctgtcgcgtggcggctacaaatgccttcagaccagttctttcaagcgatgccagagcatccctagcgccagtagcggcgaacgcaggtgcttgccgcccgggaaggtgatgtgcgggacctgggcgaacagatcgaaaccaccgccctgctggccgctgatggcttcggccagcaacttgccggccaggtgcgtggcattcacgccgtggcccgagtaggcctgggcgtaatacacattgggctggtcttttagacggccgatctgcggcaggcggttggcgccgatgccgatcatgccgccccattgatagtcgatcttcaccgccgccagctgcgggaacacctgcagcatcttcggccgcatataagcggcgatgtcccgcgggtcgcggccggaatagtggcaggcgccgccgaacagcaagcgccggtcggccgaaaggcggtaatagtccagggccacccgctggtcgcagaccgccatgttctgcggcaacagggcgtgggccagctcttcgctcaagggttcggtggcgatgatgtaactgccggcgggcagcaccttgccacccagttgcgggttgagatcgttgaggtaggcgttgcagcccagcaccagggtgttggcgcgcaccgaaccctgggcggtatggaccttgacctgcggcccgtaatcgatgcgggtcacggccgagtgttcgaacaggcgcacgcccagttgctgcgcgaccgcggcttcgcccagggccaggttcagcgggtgcaggtgccccgaacccatgtcgatcaggccgccgacgtaacggtcggagcccaccacgctgtgcatctcatgggcttgcagcaggcgggttgcatggcgatagcccagatcgtgcagctcctgggcatcttcggcgaaaccttcgaggtcgcgcggtttgttggccaggtcgcaatagccccaggtcaggtcgcagggaatctggaaacgctcgatgcgctggcggacgatttccaccgcttccaggcccatcagtttcatctggcgtacgccgtcttcgccgatgactggggcgaactgctcgaggccgtgacccaccccgcgaatcagttgcccgccgttgcgcccgctggcgccccagccgatcctgcgcgcctccagcagaatgacgctgaacccgcgctcggccagctcgattgcggtgttgagcccggagaagccgccgccgaccacgcatacgtccgcctgatgctcgccggccagcgctggataatcgggctggggcaggctgctggcggcgtagtaggaggcagggtgcgaatggcctggcaccgacgactgaacacgggtgttcatgtggatcatcctgattcgtgtgtttggaaaatttgacggagcataagccggacctttccggcgcggcaacattggtcggccagtgctgtctgccacagggcttttagggcaaaatcgcggcctctccagactcccggtaagcgcttcgatgagctgcaacagccagaaaatccgcacgctccgacagcagatcccctcgttcgagtgtgtgcccggctgtcacgactgctgtggtccggtcaccacttcgaccgaagagatgtcgcgcctgccgcgcaagacccgggccgagcaggacgcggcgatggaagagctgaactgtgtgcacctggggcccaatggctgcacggtgtatgacgagcggccgctgatctgtcgcctgttcggcaccacgccaagcctgccatgccccaatggccggcgcccggtggagctgatccacccgcgggtggagaagcagatccatgaatacatggcgagcacccggcaggtgctggtctgacccgaggccatcgcgggcctgtaggcgcgaggcttgcccgcgacagcgattgccctgacgacagggcctgcgggccgttgtaatcaatccggaatcggcaggctcaggctctctttcacctcttccatcacgatatagctcttggattcacgtacgtggggcagcttgagcaggatgtcgcccagcagtttgcggtacgaggccatttcggaaatccgcgccttcaccaggtagtcgaagtcccccgacaccagatggcattccagtacatgcggcagtttcagcacggcgcggcggaactcctcgaaggtgtcgccggacttgtagtccaggctgatttcgacgaacaccagcaggctacccttgaggtgctgcgggttgagccgggcgttgtagcccatgatgatgccttcgcgctccaggcggcggacccgctcggtgcacggtgtggtcgatagcccgaccttttcccccagctcggtaaaggagatgcgtccatcggcctgcaggatgcgcaggatattgcgatctatcttgtccagctcacgcttcgtctgatggttggtacgcataggggatgcgcctccgtgaaaagggtttttgccgagaattctcgccaaatataggcgtttatatagtgaaaagcactggtcattgctttttatactgcgcgcatcttcgctctgaataacaaacgtcagcggttatccgcgatgagggatatgaaaatgcgcgttctggtcttgggtagcggcgtgatcggtaccaccagtgcctactatctggcccgtgccggtttcgaagtgaccgtcgtcgaccgtcagccggccgtggccatggaaaccagcttcgccaacgctggccaggtttcgccgggttacgcctcgccctgggccgcgccgggcgtgccgctcaaggccatcaagtggctgctgcagcgtcacgcgccgctggcgatcaaggccaccgccgacatcgatcaatacctgtggatggcgcagatgctgcgcaattgcaccgctgcccgctatgcggtgaacaaggagcgcatggtccgcctgtccgagtacagccgcgactgcctcgacgaactgcgcgcggaaaccggcatcgcctatgaaggccgcagcctggggaccacccagctgttccgcacccaggcgcaactggatggcgcggccaaggatatcgccgtgctcaaggaatccggcgtaccttttgaagtgctggaccgcgaaggcatcgcccgcgtcgagccggccctggccagcgtgaccgacatcctggccggcgccctgcgcctgccgaacgaccagactggcgactgccagatgttcaccacgcgcctggcgcaaatgtgcaccaagctgggtgtggagttccgcttcgaccaggatatccagcgcctggacttcgccggcgatcgcatcaacggcgtctggatcgacggcaagctggaaaccgccgaccgctacgtgctggctctcggcagctactcgccgcaactgctcaagccgctgggcatcaaggccccggtgtatccgctcaagggttactcgctgaccgtgccgatcaccaacccggccatggctccgacttcgaccatcctcgacgaaacctacaaggtggcgatcacccgtttcgacaaccgtattcgcgttggcggcatggctgaaatcgccggttttgacctctcactcaaccctcgtcggcgcgaaacgctggagatgatcgtcaacgatctttatcctcagggcggtgatctgtcccaggccagtttctggaccggcctgcgtcccaccaccccggacggcacgccgatcgttggcgccacgcccatgcgcaacctgttcttgaacaccggccatggcacgctcggctggaccatggcctgtggttccggtcgtctgctggccgatctgatggcgaagaaaaagccgcagatcagcgccgaaggtctcgatatttctcgttacggtaatcctcaggagcctgcaaaacatgtcaatccagcgccagctcaccaatgagcgcatgagtcagatcgtcgtccacagcggtaccgtgtatctggccgggcaagtcggcgacgacctgaacgcggggattgagcagcagacccgtgaaaccctcgccaacatcgagcgtttgctggacctggccggcaccgacaagtcgcgcctgctgtcggtgaccatctacctgaaggacatcgatgcgcacttcgccgggatgaacagcgtatgggaccagtggctgccaaaaggcgtcgccccggcccgcgcaaccgtcgaagccaagctctgcgaaccggaaatcctggtcgagctgtccgtcgtggccgctctgccttaagcaagatccctctcccggtgctgttaatggatggctcacgccatccgccagcgccggttttttcttcccacatgaccgcctagaagtctgccgccatgcgtcctgcccgtgccctgatcgatcttcaagccctgcgtcacaactaccaactggcccgcgaagcctcgccgggcgcccgtgcgctcgcggtgatcaaggccgatgcctatggccatggcgcggtgcgctgtgcccaggcgctggaagccgaggccgacggctttgccgtggcctgtatcgaagaagccctggagctgcgggcggcggggattcgcgcgccgatattgctgcttgaaggttttttcgaggccgatgagctggacctgatcgtcgaacatgatttctggtgcgtggtgcattcgctgtggcaactggaggccatcgagcaggccaccgtcgccaagccgctgacggtatggctcaagctggattcgggcatgcaccgtgtcggcctgcatcccaaggattaccagccggcctatcagcggctgctggccagcggcaaggtggcgaagatcgtattgatgagccacttcgcccgcgctgacgagctcagttgcagcagcagcgacgagcaggtcgcggtgttcgaggcggcgcgccagggcttgtccgccgagatcagcctgcgcaactcgccggccgtgctcggctggccgcacatccccagcgactgggtgcgccccggcatcatgctgtatggctcgaccccgttcgaagaaccgcatccactggccgcgcgcctgcaaccggtgatgaccctggagtcgaaggtgatctgcgtgcgcgaactgccggccggcgagccggtggggtacggcgccaaattcgtcacgccacggccgatgcggatcggtgtggtggccatggggtacgccgacggttatccgcggcatgcgccgaccggtgcgccggtgctggtggcggggcagcgtacccaactgctcggccgggtttccatggacatgctgtgcatcgacctgaccgacgtgccagaggccgggctggcttctaccgtcgagctgtggggcaagaacatcctcgccagcgagctggcggccgcggctgacaccatcccttatcagctgttctgcaacctgcgccgggtgccacgcgtctattccggggactgagcggcacagcgcactgccgaaagtcgccttgccccctgggattggggcccaagtgttgtaaatactgaacgctatcgccatgataacgctcaactacaacaacgcctgatccctaggaggctgccgcattggacgtcggtgaacgactgcaatccatccgtaaactcaaaggcctttcccagcgtgaactcgccaagcgcgcgggcgtcaccaacagcaccatttcgatgatcgagaagaacagcgtcagcccctcgatcagttcgctgagaaaggttcttggcggcattcccatgtcgatggtcgagtttttctcggaagaaatcctccaggaaaaacccacccagatcgtctacaaagccaacgagttgatcgatatttccgatggcgcggtgaccatgaagctggtgggccgggcgcatccgagccgggcgattgcttttctcaacgagatctatccgccgggcgccgataccggtgaagagatgctcacccatgaaggcgaggaaaccgggattctcgtggaaggacgcctggagctggtggtgggtcttgagacattcgtgctcgaagccggtgacagctactatttcgaaagcaccaagccgcaccgtttccgtaatcctttcgatgcccccgcgcgactaatcagcgcagccacgcccgcgaacttctaatagaagaggcgtcctgcaaggattgcagcggtgcccgaagcagcatttcgcctctctctaatccccctttgaatctagggttgtttcagagtggcgggctaaccgctatacttgcgcccgcccgcgaaaccgtggccgtgggcgtgactagccaccattgagggtgtacgcgtgaacctaattatgaaaatgctggctgcaccagcaaccgtattggccctctgggctgtcagcgctcaagctgcgaccaacgacgacattgccaagcgcctcgagccggttggccaggtctgcgtccagggtcaggaatgcaagggcatggaagtcgctgttgccgccggtggcggtggtgcgaaaactccagacgaagtgattgccaagcattgcaatgcttgccacggctccggcctgctgggcgcgccgaaaatcggcgatgccgctgcctggaaagagcgcgcggatcaccagggtggcctcgacggcatcctggccaaggccattaccggtatcaacgcgatgccgcctaaaggcacttgcgccgactgctccgatgaagagctcaaaggcgccatccagaagatgtccggcttgaaataagcacggatcttgcgcaaaaaagccgcttacgagcggcttttttcatgcctgcgattcggccgctactgttcattgcagcaaagacccggcaagctcggtccaacctcaaattcatggaaggtactggaggatcggatggtgcagtcatgttctatcgagcgggcggtcgatgaggtcctggcacgcttgccagcgcatattcacatgggtatgcccctggggctgggcaaacccaaccgcttcgccaatgccctgtatcgtcgcatcgcgcaactgcccgagcgccagttgaccctctacaccgccctgagcctgggccgcccgccgctgggcgatggcctgcaacggcgcttcctcgagcctttcatcgagcaggtcttcggcgactaccccgagctggacttcctcgccgacctgcaccgcaaccaggtgccggccaatatccatatcgaacagttcttcatgcagcccggcagcctgctcaacagcccggcggcgcagcaggattacgtctgcagcaactacagccacgccgcgcgcgacatcaatgccgccggcctgaacctggtcgcgcaactggtggcccgggacccgcagcaaaccgaccgcctgagcctgagttgcaacccggacatcaccctcgacctgttgccaatgatcgccgagcgacgtgccgccggtgaaaccatcctgctgctgggccaggtgcatcgcgacctgccttacatgccgggcgacgccgaaatcgacgccgccaccttcgacctgttgatcgacgaagaggagggcagcacgctgttttccacgccgaacatgccggtggggttccaggatcactttatcggcctgcacgccagcactctggtgcgcgacggcggcaccctgcagatcggcattggctccatgggcgacgcattgacggcggcgttgctggcgcgccaggcggataacgacggttatcgggcgctgctggcggacctggagatccagtgctggaagccgctgatcgagcgcgaaggcgggatggagcctttcgccaagggcctttatggctgcagcgagatgttcgtcaacggcctgctggtgctggccgatgccggcatcgtacggcgcaaggtctatccctcggtggccctgcagcgacaggccaacgccgggacgctggatgaagaccaggcgctgggcggggtgtcggtgcatggcggctttttcctcgggccgcgcagcttctaccagcgcctcagggatctgcccaagagcaagctcggcgagttcaacatgaccgccatcagctacatcaacgagctgtacggccacgaagaactcaagcgcctgcagcgcctggatgcgcggttcatcaacagctcgatcatggtcaccctgctgggggccggggtggcggatcagctggaagacggccgggtgctcagcggcgtcggcgggcaatacaacttcgtcgcccagggccatgcgctgcgaggcgcacgctcgatcctgatcctgcgcagctggcgcgaatccgcgggcctggtcagctccaacatcgtctgggaatacggccactgcaccatcccgcggcacctgcgggacatcgtggtcaccgagtacggcatcgccgatctgcgcggcagggccgatgcgaaggtggtcgaagcgctgctcaatatcagcgactcgcggttccagccgggcctgatcgaacaggcgcagaaggccggcaagctgcccaaggatttccgcctcgatccgcgttttaccgacaaccatccgcaacgcctgctggcgatccaggcgcggcaccggcacctgttcccggagtacccgttgggcagcgacttcagtgcgcaggagcgggatttgctgcgggcgctgaactggctgaagagcaagttcaagctcagcgagattctcgaattgggcaaggcggcgctggatgcaccaccgcccgaggccttcccggcgcatctgcagcgcatgcaactggtgaagcccgatggctggcgcgaggagatctatcagcgtttgctgctggccgccttacgcgagacggcgcaggcataaggtagacgcctggcggcatcatcgcgggcaatcgagcgtcgaccggctgctcctgcagaagcgggtggtctctgtaggtgcaaggcttgcccgcgatcaagaggcgacgcctcttagataaaggtcaccacgccaccggccagggacttgacccgggccagggattccacgcggtagccttgcgcgtccagttcggcgcggccgccctggaacgacttctcgatcacgatgcccaggccggccacggtggcgcccgcctgcttgatgatcgagatcagcgcctgggacgccttaccgttggccaggaagtcatcgatgatcagcacgcggtcgctgctggtcaggtggcgcggggaaatcgccacggtgctttcggtctgcttggtgaacgaatacacggtcgccgacagcaggttctcggtcagggtcagggactggtgcttgcgcgcgaagatcaccggtacgcccaggttcaggccggtcatgatcgccggagcgatgcccgaggcttcgatggtgacgatcttggtgatgcccgagtccttgaacagcgtggcgaattcgtcgccgatcagcttcatcaaggccgggtcgatctggtggttcagaaaggcatcgactttcaggacctggtcggaaagcacgatgccttcttcgcggattttcttgtgcagtgcttccatgaagctttcctctgttgacgccttgtgcgcctgagctctgataaaaggtgttcggttaaaaatgctgcggttaaaaagtgctcgattctagcgctttaacatcgcccgtatatccgccagtgcattgttgccgcgcacggctttgacttcggtcggggtgtcgtcgttgccttcccacgccaggtcgtccggcggcagttcgtcgaggaagcggctgggcgcgcagtcgatgatctcgccgtactgcttgcgcttggcggcgaaggtgaaggccagggtctggcgcgcgcgggtgatgcccacgtaggccaggcggcgttcttcctcgatggtgtcggcttcgatactggaacggtgggggaggatttcctcctccatgcccatgatgaacacataggggaattccaggcccttggaggcatgcagggtcatcatctgcacgccttcggcgccgtcttcctcttcctgctgacgctccagcatgtcgcgcaacaccagcttgccgatggcgtcttcgacggtcatttcgccgtcttcgtctttttccagggtgttcttcagcgcctcgatcaggaaccacacgttacccatgcggtagtcggcggccttgtcgctggagctgttggtgcgcagccagttctcgtagtcgatgtccatgaccatgctgcgcagggcggaaatcgggtcttcgccggcgcactgctcgcgcaccttgtccatgaagcgcttgaagcgcgccaggcggtcggtgaagcggctgtccaggtgctcgcccaggccgatctcgtcggtggcggcgtacatcgagatcttgcgttcggtggcgtagttgccgagcttttccagggtggtcgaaccgatttcccggcgcggcacgttgatcacccgcaggaaggcgttgtcgtcgtccgggttcacgatcaggcggaagtaggccatcaggtccttcacttcctggcgcccgaagaagctgttgccgcccgacaggcgatagggaatctggtgatgctgcagtttcagctcgatcagcttggcctgatagttgccgcgatagaggatcgcgaaatcgctgtagggccggtcggtgcgcaggtgcaggctgaggatttccatggccacgcgctcggcctcggcgtcctcgttgcggcagcggatcacgcggatctcgtcgccatggcccatctcgctccacagctgtttctcgaactcatgggggttgttggagatcagcacgttggcgcagcgcaggatgcggctggtggagcggtagttctgctcgagcatcaccaccttcaaggacgggtagtcctccttgagcagcatcaggttttccgggcgggcgccgcgccaggcatagatcgactggtcgtcgtcgcccaccacggtgaactggttgcgcttgccgatgagcattttcaccagcaggtactggctggcgttggtgtcctggtattcgtccaccagcaggtagcgcactttgttctgccacttctccaggatgtcggcgtgttcctcgaacagcttcaccggcagcaggatcaggtcgtcgaagtccaccgcgttgaacgccttgagcgtgcgctggtagtgggtgtagacgatggctgcggtctgttccttggggttgcgcgcgttttccagggcctgggccggcaggatcaggtcattcttccaggcgccgatcatgttcttgatctcgtcgacgccatcgtcgcccgagtattccttttgcatgatgtcggtcatcagggccttgacgtcggtctcgtcgaagatcgagaagcccggcttgtagcccagccgcacatgttccttgcggatgatgttcagccccaggttgtggaaggtcgacacggtcaggccgcggccctcgccactgcgcagcagggtgccgacccgttccttcatctcccgcgcagccttgttggtgaaggtcatggcgacgatgtactgcgcgcgaatgccgcagttctggatcaggtgggcgatcttgcgtgtgattacactggtcttgccggagccagcaccggcgagcaccaaaagagggccgccgacgtagttcacggcttcttgctgccggggattgagtcgggacatgacaaaaaaaggggtctgtagcgaaatgggcgggcattttaacaggctggacggattctgctgctctctgcgacttgtgacgcagcacgctatctaaatttgccggttttgatactttccctcaggatgcgcgctgaatatgcgtctaatgttcgagttagagcggtacaagaaattgcgtttgataatcagtatcattcgtcattgtttatctacgcgtcataatgcccgccgccaacttctattacagagtctagggagctagcttgtccaagcctgtcgaacccttgcgcttgctgctgctggccgaagagccggcgtgggctgcgttgttgcgcgagtgtctcgctccgttgggagactcggtggtgctgatcagtgcgccgacctgggaatctgtcagccgtctgttcgataaagatcgctctgcgattctgttaaccgttccccaactgcaaccggctcccggtcgttgcagcctgcccacggtattgctgctggagcaggagccgctgaacacgccagccggcgccagcgactggctggtgaataaaaacctcagtaccgatacggtgcgccgttgcctgcgccatgtgcgtgagcgcggggtactggaaagcaccctgttgcgcctggccgagcaggaccctttgaccggcatcgccaaccgccagggtttccagaccctgctggcggcgcgcctggcggaaaaccaagggcgcgggctggcgctggggcacctggacctggacaacttccggcatgccaacgatgcgctgggccaccaggccggcgaccgattgatcctgcaagtggtctcgcggctcaagagccagcttgaggccggggaccagctggcgcgcctgggcagcgacgagttcgccctgctgatcgatacccgccgggcgccgcaccgcgccgagtggatggccgagcgcatcgtcgaagtcatggccgaaccctactggatcgacggtgaaagcctgttgatcggctgcagcctgggtatcgcccacgccagggcgaatgccggcgccgacccgctgatgtggcacgcgcacatcgccatgcagcaggccaaaagcacccagggctgtacctttcatatcttcaacgaacgcatcaaccgcaatgcccgcagcctcgcggacctggaaagcgaactgcgccgggccttgcgccgcgatgagctggagctgcactaccagccgcgcctgaacccgcatgacgggcagatcgtcggcctcgaggccctggtgcgctggcgccacggtgagcgcgggctgttgccgccgagtgagttcgtgccgctggccgagcagagcggcctgattgtgccgctgggctactgggtgatttcccgggcgctgcgcgacatgcaggccctgcgcgaacgcggcctggcgccgctgcacatggcggtcaacctgtcgttccgccagttccaggacagccagctgctgtcgaccctcagccggctgattgccgagcggggggtcgaggcgcaatggctggagttcgagctgaccgaaaccgcggtgatgcgccgcagcgacctggtcaagcagaccatggatgcgctgggccggctgggggtgcggttttccctggatgatttcggcaccgggttctcgtctttcgtgcacctcaacagcctgccgatcgccctgctcaagatcgacaagagcttcgtcggcggcatggagcagcgccaagagaaccgcaagctggtgcacgccatgatcaacctggctcacaacctccatctcgaggtggtggccgagggcgtggaaacccctgagcaactggccttgctgcgcagcttcggttgcgatcaggtgcagggctacctgatcagcaagccgctgccgctggcggaattggtggagtacctgacgttcggcgcaagccagcaggtcctggtcggcgaggtcagctgacggcatcccgctgtagcggcaggagccctcaagctcctgccgctacagggaatcctgggcggcctggaagttatcccgcggagcaggctccgcgccttcctggcgaatcatccggcgcatcttccattcgaaggccagggtcaggctgatggcggcgcacgccagccccgatgccaggccccaccacacgccggtcgcgccccagcccagggtgaaggccatcagccaggccgccggcgcaccgatcagccaatagcagcccaggcccacgaggaaggtggtcttggcgtccttgaggccgcgaatcgcgcccatggcgatggtctgcgtgccgtcgaacagctcgaaccaggccgcgaccgccagcaggctgaccgccaggttgatcacgtcgcgaaaggccgggtcgttatggtcgaggaacagcccgatcaactggttcggcagcagccagaagaccatggcgaaacccagcatggccgcgccgccaaaggcgatcccgacccggccggccatgcgcgcgtgcatcagttgcccggcgccgtagtgctggccgatgcgcatggtgatcgcgtaggagatcccggccggcaccatgaaggccacggagacgatctgcagggcgatctggtgcgccgccagctgggtgctgcccatggtgcccatgcacagcgcggcgaaggcaaacaacccgacttccaccgcgtaggtgccgccgatgggcaggcccaggcgccagagctcccgcaggtactggcgattgggccgcgccaggccctggcgcagcgggtaggcggcataggccgggtggcgcttgatgtgccaggccagtgccagggccatgcagttggcgacgatcgcggtgaccaggccgatccccaccagccccagtttcggcaggccgaacatgccggtgatcaaggcgtaattgagcaggaagttggccaccgtgccgcccaggctgatgaccatcaccggcgtggcacggccgatggcgctggtgaaaccgcgcagggccatgaagctcaggtagccgggcagggcgaacggcaggatcagcaggaactggccggcggactgcacgttggtttcggtctggccgaacagcagcaacaccggcttgaggttccacagcagcaggccggcgaccagcgccatcagccacgccagccagagcccggcctggttcaggcgcgcggcgccttcgatgtcgccggcgccctggcgaatcgcgaccagggtgccgaccgccgcgatcacgccgatgcagaagatcgacacgaacgaataggtggccgcgcccaggccaccgccggccagggcttccgggctcaggcgggccatcatcagggtgtcggtcagcaccatcagcatgtgcgccaactgcgaggcgatcagcggcccggccagccgcaggatggcccagagttcggtgcgtgctggatgctgcatggtcatcggtctcgatacgggggagggagtcaagagggttgattctcggcgctctcggcgactttcacaaagggataaaaacgattggtggcatgattaaaactcatgcttgcggattctggtaagttggtgccattgcgcctgtggagtgctgccatgccccgtcgtcttccgcccctgtatgccttgcgcgcctttgaagccgcggcgcgacacagctcgttcacccgcgcggccgaagagctgtcgatcacccagagcgcggtcagccggcatatccgcaccctggaagaccacttcgcctgccggctgttccagcgcagcgggcgcaacctgcaactgaccgaagccgcgcgcctgctgctgccaggcattcgcgagggcttcaccgccctcgagcgcgcctgcgataccttgcgcgccgaagacggcatcttgcgcatgaaggcgccctcgaccctgaccatgcgctggctgttggcgcgcctgagccgcttccgtcatctgcaaccgggcaacgaggtgcaactgaccagcgcctggatggacgtcgattcggtggacttcaaccaggagcctttcgactgcgcggtgctgctgagcaacggtcactttccgccggactgggaggccagctatctgtttccggaattgctgatcccggtgggtgcgccgaacctgctcaacgaccagccgtgggacgtggcgcgactggccaccaccgaactgttgcacccgaccccggatcgccgcgactggcgcaactggctggagcgcatgggcttgtccgagcaggtctcgctcaagggcgggcaggtgttcgacaccctggagctgggcatgatcgccgcggccaggggctacggggtttccatgggcgatctgctgatggtggccgaggatgtggcccaggggcggctgagcctgccctggccgacggcggtggccagtggcgagaattactacctggtctggcccaagacccggcctggaggtgaacgtttgcgccgcctcagcgactttctccagaacgaggtccgcgccatgcaattgcccgacgtagagcggctcggctgaaacgatgaaggccccatgaccaggggcctgcgcgatacccgtccaacgcgctcaagtattgagcggcgccgccgaatccttggaagtggaaccttcgttctgatcggttccgacatctcattcttattagaaccattgccgagtgtgtgacgcgatcaggacgatccggtctctcggccaggagctgtcatgcctcaacctcgtgcccggatcgcctcgcagcttggtctcgcactcgccgtggtactggcgatcgtgatcagcggcagtactgtcttcgccctgcgctcgctggacgccgccaacctcgccacccgggaagaacacctggccagtgaggcacggctgctggccgaccagctcaataccttccacggcaccctgcgcgaaagcacccagcgcctgagcgggctgttcgaaaagcgtttcagcggcggcctgagcctgcacccggaccagccggtgaccgtggccggtacccagaccccgggcctgcacctgggtgacgtgctgctgaacaacaacttcgaggaagtcgacgagttcaagcagatgaccgccggcgtggcaacggtgttcgtgcgcagcggtgacgatttcatccgcgtcagcacctcgctgagcaagcaggatggcagccgcgccattggcaccctgctggaccacgcgaacccggcctaccagaaactcatggcggggcagagctatgtcggccgcgcgctgctcttcgagcgtctgtacatgacccagtacacgccggtgcgggacagcgccggcaaggtgattgcggtgctgttcgtcggcttcgattacaccgacgcgcagaacgcccagttcgacaacctcaagcgcttccgcatcggccagaccggttccctggcgttgctcgacgagcagcataaatggctggtgccgccggccggcgtgcaggccctggagcagtcggcaacgaccattaccgagttggccaggcagccgggcaaggggcgcttctggagcgacaagagcgaggatttctacagtgtcgccgtccccttcgaaggcgggccctggtcggtggtggcgagcatgccgaaagccgaaatccgggcagtgacctggagcgtcggtgcgcgcctggtcatcggcagcctgctggcgatgctgctggcggtgggcgccacggtctggctgctgcgcagcaaactcgcgcccctgggcgacttggtacgccaggccgatgccttgggcaaaggcgacctgagtgcgcgcctgaatgtcgccagccaggatgaaatcggccagttggcgagcagcttcaaccagatgggccaggccctgtcgaccatggtcgagcatatccgcagggccgccgaggaggtcaatggccgggcccaggcgctgtccgggctgtcgggtggggcgtacgagggcatggagcagcagtcgggtgagatcagcagcatggccggggcggtggaggagttcagcgccacctcgctgaacatcgccgacaacatgggcaacaccgagcgcctggcccaggaaaatgcccagcagacccgaatcggccgcacctcgatggaagaggcttcggcttcgctggagcagatcgccggcgccttgaacagcaccgctaccgtgatcaacaccctgggccagcgctccgaggaaattggcggcatcgttggggtgatcaccgcgattgccgaccagaccaacctgctggcgctcaacgccgccatcgaggccgcgcgcgccggcgaacaaggccgcggctttgccgtggtcgccgacgaggtacgcaacctggcctcgcgcacccgcgaagccaccgatgaaatctcggggatgatcaacagcatccagcaggaaaccggcaacgccatcgccaccatggagcagggcaaggtgttgatgcaggaaggcctgtcgcgcaacgccaatgtcgcctcggccctggcgcgcatcgacgagcagagccgctcggccggccagcagttcgccgcgatcaccaccgcgacccaggagcagagcagcacagcgaccctgctcagcagcaacctgcaaagcattgccctggccaacagcgaacaacgcgaagtggtgtcgaacctggcgatcaccgccaaggagctggagaagctagcggcggacttgcgccaggaggtcgaccggttccgttgatagcggttgcgtgaccgttggccacggctggggaggcagattgcaaatgcgcggggctgggctaaaccataggggcgatttccctacaggatgccttcccggcaggagctgacatgtcccgtcacactcgttttgccctccgtaccgtcgtgctgcccctggcactcgtcagccagatggcgtccagccaggaggccgtgggactcatttccccggcttcctggtacaccgccttcaacgctatcgcccaggtggcgtgccataactgctacgaaaaacagtacgccggcaccttcaccagcgtgctcgacagcgtgcgcaccctggagctggacttctgggaccaacgcgatgcggtcaccggaggttcgccccgccactggttcgtgcggcacaaccccggcagcctgttccagtccggcaatgacaacaattgcaccggcgacggcaaaggcaccaacgatctcgaggcctgcctcaacgacatcaaactctggagcgacagccatcccgggcacttcccgattaccctgatcctcgacaagaagcagggctggtcgaaggaaagctccgggcgtacgccgaaagacttcgatgacctggtcagccggattttccagggtaagctctaccccgggcgacctggcccagcacctgggtgtcagcagcagtgccttgcagggctcgctcaagggcaagtcctggccgaccgccagccaactgcagggcaaggtgctgctggtgctcaaccactcggagaaccagaaactctcgcaatacgccgaggcccgcaccaccagcgccaaggtgttcatttccccggtcactaacggccagaacgatgtcagtggcgaggtcagcggcatgtccaggacgtcgtccggctacgtggccatgaacaacatgggcaagggcgacaagcagtgggccgcgcaagcctttgcctacagccacatcggtcgcgtgtggggtgatgacggcgtgtcattcacccagcacatcgccgagaaggtcaatctgtcggcgtattacaagttcgccgaggccaaggatggcaatggctatcgcatccggccgttctgaggtttcagcggggctcggccggttcggcaagccccgggtccacccgcttgccgatatcccgcaggcgcgccagttggtcgaccatggtcggcgcttcatccaggctgctgacaaaggtccacaggtaggtcatcaccgcgtacacatggccggccttgaccccatcggtcagggccagttggctgatggcgatcacgaacagcagcgcggccgccgagccaagcagcagataggccgccgcctcgcggtccgacagccagatccgcagccgcgacagtagccggtagtgccgttgcagggacgtggcgccgaccttggccaccaggccgatttccttttccagccggtcgttcaggcgctcatgcagctcctgattgtgtcgggcgaagcgcggcagcagggtgatgcacagcagcaaggccaccaggcaggccaggccgacccagggttcgatcaccagcagcatcaccgccgcaccgacaatcgagactagggcggtggcaatggtcggtacatgtttctcgaagaaatcgacgaactcccgggccagtaccaccctcgctgcggcggtggaggtgctctggttctgcaggcgctggttgagaatcaccggcaccgccaggtcggcgtagatccgcgtgaaggtgcgggtatccaccgcccgccgcgcggccccgaccacccagaacgccagcaccaccagggcatagaccagggcactgccggcgtcgccgcgaatgatcgagtccacggcgaacccggcaaacagcgggtaggccagcagcaacgcgttctccagcgccaccagcgacaaggtgcagaacagcttgccggggtaggcgcgggcgatggctttcagggtctggctggcggattgctggccgatttttttgctttcatcgatcaggatttgcggggtaacggctgacatgggtgcaccggagggaagataaacgctattattgagcgactgctcaatagtatttgagcgatcgctcaaaacgcaagcgccgtcgatccaccggcgcccagaggcaatgcccgcatgtcccgtgccgaccgcaaagaccagatcatcgccgccgccctggagctgtttctcagcaagggcttcgccgcggtttccacccgcgacctggcggaccatgccggcctgtcccgtagccacatctatcactacttcagtgattggaacgaattgcgccgcgaagccttcgtgcgcttcgccaatgagcaactggacgccgtaggcgcccccctggttggcttgccgccgctggaggccctgcatggattcctgcgcgattgcctgccggtttctgccgaagacagttgggcgctgtggctcgatgcctgggatgaagccatgcacgacaccgcgctggccgaggcctaccagaaggtggatgagcagtggcaggccatactcgccagcatcatcgaagccggcgtgcaggctcaggtgttccagtgcgcatcccccgcacgcgcagcccggcagatcttcgccctgatcatgggctatgccgacggcctgttgctgcgaccctcggccgaggccgctgcagcggcgatggacgaggtgatggaagtggttgagctgttattgaagattcgctgagccctgaagaggcgttcgagagtgccggcctgttgcggaaattaggttgctgaaacgattcatcagcgctataaaaatcccacaactccaataaaggcacacgcccatgacaccgctcagactgctggtcgctctttccgcattcaccgctgcttcccacgccatggcctgggactatgtcctgctcgataccgacaaggccgcccaggatttccatatcaccagccaacagctgggagtaaagaccgaacaacccttttccgtgaccctgcgtaccctgcatggcgggcggcaggaaggggtgagcatcgtcgatatcgacaacggtgcgatgaaactctctgtggtgccgacccgtggcatgaacgtgctgcaggcttccgtcggcccggtgcgcatggggtgggactcgccggtcaaggaagtggtcaacccggcattcatcgagctcaacggtcgcggcggcctgggctggctggaagggttcaacgagctggtgacccgctgtggctacgagtgggtcgggcacccgggcatggataacggcgagctgctgaccctgcacggtcgcgcggcgaacatcccggcgaacaaggtcaccctgcatatcgacgagaagccgccatacgccatcagcctgcgcggcgagctcaaggagcaggcgttcaagaaggtcgacttttcggtggccaccgagctggtgaccgagccgggcagcgtcagtttcgccctcaacgacaccctgaccaacaacggcgactatccgaaggaataccaggcgctgtatcacagcaacttcagcacgccgttcctcgaagagggcgcgaagttcgccgctgcggtgaagcaggtgtcgccgttcaatgacaaggccaaggccgaccttgccgattggcagatctaccgcggcccgacccgggattacgacgagactgtctacaacgtggtgccgtacgccgatgcccagggcgacaccctgacggtgctgcacaacaaggccggcagccttggcgtggcggtgggcttcaatacccggcagttgccggtgttctctctgtggaaaaacaccgatacccagggccagggctacgtgaccggcctggagccgggcaccagtttctcctacaaccgtcgctaccagcgcccgctgggcctggtgccgaccatcgaggccaggcagagcaagcaattccagatccgctacagcctgctggccgacaaggcggctgtggataagtccctggccgagatcagccagatccagaacggtcggcagaccgaagtacggccgacgccactggtggacctgagcaaggagtgattctcctcaactcgcggccggccggtattgcagcgcttcggccaggtgctcgcggctgatctgctcggcctgctcgaggtccgccagggtacgggcgaccttgagcaggcggtgggcggcgcgcagggacagggtcaggcgttcgcaggcgatttccagccagcgctcgtcggctgtggataactggcaatgccggcgcaggcccggcaggtcgagaaaagcattggcgcaaccctggcgccgttgttgccgctccctggcgcgggccaccagggccgcggcttgcgcggtgttatccccagcctggggcttggggttgagggcggtgctttcccgagccacggtcaggtgcaggtcgatgcggtcgagcagcggcccggagagtttgttgcgataacgctggatctgctccggcgtgcagcggcagcggccactgggctcgccaagatatccacaggggcaaggattcatcgccgccaccagctggaaacgcgccggaaaatgcacccggtcgcgagcccgggcgatgacgatctgcccagactccagcggctcgcgcagcacctccaataccttgcgatcgaattccggcaactcgtcgagaaacagcacaccgtggtgggccagggtgatttccccgggttgtggtttcgagcctccacccaccagggctggccctgacgcagagtggtgcggctggcgaaacggtcgctgcggccaatggctcagcggagtatggctggtgaccgactggatggcggccacttccagggcttcctgctcctccagcggtggcaacaggccgggcaggcggctggccagcaaggtcttgccggtgcccggcggaccactgaacagcaggttgtgcgcaccagccgcggccaccagcagcgcgcgtttggcggccagttggccctgtacttcattcaggtcggggtagggccggttctggtagagcagaccgtccgaaacatagggttcgatcggtgtatggccgttgaaatgcgcaacggcttccagcaagtgctcgacggcaatcaccttcagtcccgacgccaggcaggcttcctcggcattcgcgcgcggcaccatcagcgtgcgtccggcctggcgcgcggccagggccgccggcagcacaccgcgcaccgggcgaaccgcgccggaaagcgccagctcgcccaggcattcgacttcctccagggccagggtcggcacctgcacgctggcggcgagaatgcccagggcaatggccagatcgaagcgcccgccgtccttgggcaggtcggccggggcgaggttgagggtgatgcgccgggctggaaaatcgaagccggcattgagaatggcgctgcgcacccggtccttgctttccttgaccgccgcttcgggcaggcccaccagggtcagggccggcaggccgttggccagatggacttcgaccgacacggccggcgcttgcacgccggtctgggcacggctgtggacaatggccagagacatgactcgttccttgaggctggggaaccgcgtcctgcggttgtgcaagcctagccccggccggagcatcgccgcgccggaaaatcggctcaggatgttgcggcgagtggctcagccgcgccagtcgtgggaccagcctggttgggcgatgcgctgttcgtacagggcgatgtccgactgattgtcgacttccacccagccgccgcgaatggccacggtggcgatggcggtgccggcctggagcagggcgcgcagcaggctggtcatgtccagtttgtcgatctgctgctcgctcatgccggccagcagcgcctggacctggctccagcccgcgggggtgaatttcagcaggcccatgtactggccttcgatttcctcgtggctggcgaccctttcaccgatacccagcagttggccggcctgttggcggaagctttcggcatcgctgagggggtcgtcgaagcgcgtcgaccacagatcccaccagtcgaggtcgtaggtgatgctcaggggcgcctgggaggccatcaggtcacgaacgatgtccgggcgatagacgatgtcgccgtagcacaccagggtcggttcgctggacagcagggcgtcggcgcgtatcaggctgcgcaccatgttgctgctggcccaatgcgggttgtacagccggctctggccgtagccttcaagggcttcactgcaataaccgctgaccagatgcacctcgtcgaccccggcgttttccagggcgtgcaactgccattcaagcagcggcttgcctgccaggcaggccaggggcttgggttgcgcggcggtcagctgtttcaggcgggagccgcggccggcggcgagaattacggctttcatgtcaggtcactcaaagagccattggcacagttgtcgatcggcttcgtccagcgctgcttcgcgctcgggatgccacatgatgccggccaccttgaggtgggtatgcaccagggcctcgcaggtcccggcagcgtccagggcccaggggcgcagggcggcgggcaacgggtcgagcaactgtttgccgtggaaggaattgaccgagcgcgaagccgcctggccttgtagccagggcagctcgtcggcggccagcaaggtgatgaggtggcgttgtgcgacgtgcacgtcgcgatcggcatcggccagccggccgccgaaaaagctgtggatcagttgcaacccgcggcagacccccagcaccggcagccgctcggccacgcagtgggccagcagcgcctgctcgctctgatcgcgcaacgggtcgctgccgagatcgtcgccgccgctgaagatcacgccttgcacgccctgggcccgggcataggccacggtgtcttcgcccaggttgggcagcagcagccattggtggtcgcagccgagctcggcaaaaaagcggtaccagtccctggccaggccatcgcgcggttcgtcgtaggcctgcgggttgcaggttctcagggtgatgccgagacgtttcatggctgcaccgggctcagggtcttgtcgcgacaattgagggcgatgcgcgggctgcgcaggatccggttgaacagctgttcgccgcagccgatggccgccggaataccgaactcggcgcagcggatggccatgtgcgagttggccccgccgtactgggtgaccagcccggcgatgccacgggtgaagacccagtcgtagccgggatcggcattctcgatgcagacaatcttgcccttgagcggcgccgaggccggggtgtcctggcgcagttccatgccgatggcttcgacgttctgtcgggtgatgaagttgggcaggctgcgatgcagcggcgcgacgaacacatcgtcgaccgcgctgatcaggtgcccgagcttcagcgagatgccctgttcatagctgcgccgggcctggctggccgactccagcaggacccggtcggtgtcgtccatcagcggcgcggtgaggctgtcgagcagcgggtggatatcgagaaaggacaagtcttccctggccaggccgacgtcggcgccccagctcaccagcaattgcagggcatcggacaggtcccgggtgaacaccagcttggcgtattcccgggcctggatggcctggctggcgtagtccagcaggtgttcggtcgacagcggccagccctgctcgtcaatcagccgttgcagggcctggcgttcttcgggttgcagctggaatgccgtctgcgggctctcgccgtgacccagctcgacggtcgcggcagcgaacaggtcgtggcgctcgtcgtagcgcagtgaggtgatgtcgtaggtgccggggcgcaggtggccgaacttggcgacgaacgccggcagggtacaggcatcggcgcagacctgggcgtattcgcgcgtcaattcggtggtgacggtgtggatcgattgcttccaggccagcaggcgctcgttgctcagggcgccccggcggcaggccgaacgcagcagggcctcggcgatgaacgcatgccgggcaagcatggcgaacggcagcgtgccttgctcgcgacagtccagcagcaggcggtggatgctgtcgaggtcggccggcagggcgtcgaggcgccggctttgctgccggcgctcatgggtgcgcacccgatcgagcaagggcggcagcgcgccggctccctcaccgctcagcgcccgcagcgtcagttgatcgagggccgtgcgataggcccgttgttcgacggcgctgaggctgtcgccataacgctcggcgaagtcggcgtcgaaggtgaagtccaggcaggtctggacgacttcgaactcgaccttgtcgtgccattgcggatgggcctgcaggcgctgcagccaggcattgaccaggcgagtgcacaaccccggttccaggcccgccggcaggaatgagttgaagctgcagcgcacgtcgatatacgggtgatggccgagcatcaccatcagggcctggtgtcgcgggtggtggtaacccatcagggcgcgggcctcgcgccaggtcgaatccgtcaccaggcgccgatacagcgaggccgccagcgggcgcggggtggtgccgatgatttccgccggattccagtcaggcatcacccccagcagggtgctatcgccatacaggccggcctggggcgccaggcgtttggccaggaagcgctggatgtgctccagctggcgcgccacccgccgttcggtgaccgggtgccaggtgttgcacagggtgatgcgccgcacctgcaggacatagacctgctggtggtggtcgacggcgaactcgatgtccagcggcacgttaccgcagagcgtttccagctcccggcaggcatcgatcactgcctgcaagcgcggggagcgcagctgggcgctctcggtgtcgcggtacaccagcacggttttctggatgccctggccgccggtgatggtatcggtcaggccgctctcgtcgtcgtagttcaccacgtaataaggggcgccatgctccaggtcgtgggtcatcaccacgccgctcatctggatcgaggtcagcatcggctggatcaggatctggttgtcctcgcagcggtgctcggcaaaagacgtgatcacctgttcgatggcgacgctcaaggcccgagggtcggtgatactgacattcaggcaactggtgaacaggccggccatggaactgttgacgctgtcttcgttctgcgcgctgctgcgcacgatcacgaaaaagccgtcaggctccagccgggcaatgttctgcagcacgtcagcgggatcgtcccgccactgccgggcggtgaaaaagtacagcggcaggatctgcgaacgggtgacccgcggctgcaggcgctccagggtttcggacttggtcccgaaacgaacgatgttttcggcgaccgggttcatggcgcgtccttgtgtttgtccaccgccagcagggccaggtgtttgagcaacgggtgaatgatgaagtaaggcggcttttcggcttcggccggcaggggccgcagggcttgggcgccttcgcgtcgccagtggccgaggacttccaccagcaggtcggcgcggatcgcattgtcatacaggtagtcgacatccatgcccggtgggggcaggggataggtcttgcgcgccagcaccgggccggtgtcgatctgctcgtcgagcagcagggcgctggcggcgcattcacgctgctcgatgatctggtagtacagggtggtgctgccacgatagtccggcagccagccggagtggatatgcagcaccgggtagcgactcagcagggccgccggcaccagttgcccgccgtagccggagtagacgaccaggtccggcgcctggcggtcgatcagcgcgagcagttgtggatcgtcgagggcctgggccgggcacacctcgtggggccagtccagggccgccaggcaggtgtcgaggtcctggctcaggtccgggcagaacagctctgcgagagactgtacctgcaactcgcgggtggtctgtaacgagccgccgccctgaccgtagacaatcaccgcttcaggttcgataccggctgccgccaagccttgcaggtaggcgaccgagcgcgcggtgcgggcgcagaggatcagcaggcgggcgcggctcataggccggcctcccgggcgactgtggccagcacctgttgttcctgggtcagcagccaggccaggtaggcgccctggtccggggcgaggcggccctgctgcgacaccagggtatccgtcagcttgagcaggccgctgaggtagtaggccgcgccgctcgcctgccagccgtgcagcatgcactcggccagcagcaggtaaggctgtacggacccatagctgccatggggcagcggacggtgcggagccgcggcttcgtagccggcatacaggcgtttgctcacttcgaatttcttcagcaggcgcggcagccagtaggccgccagagggccggagacgccagcgcccgcgcgcatttccaggcacaggtggcccagcagcgccgtgctgtccccggcgtgcgccgggccttgcggatacagcgcaggcaaggctggcgccggcaggtgggcgcatgcagccaggcgcgaggcgcgccaggcgtcgacgaaggcttcaccctggaaactgctgtagcgataggtctgcggggtttccagcaggtccccgtcgctgtaggcgtagttcagcatgatggtggatacccacagagctggcgaatgcgttccacatagcccgagatgtcgtcgggctcgtgacggttatgcagcaccaggtccgggcgttgcggcggcgggtactcgatgtccacgcccaccacgttgctctgttcgcctcgcagggcggactggtaaagccccttgttgtcacggctgatcagggtgctcagcggcacatcgacgaacacttcacggtagctggagaaacgctggcggttgtcgtcgctgatgtcctggaacatcgacaggatgcagcagaccacatcgatgccctggctatcgagccagccgcacagggcctggatccgctcggcgttgacccggcgtccggcgacgctgtaggcgtccgcctgctggtcatggcggaacagcgcgcgaatctcgtcgccgtcgacgaatacggtctgcggccgttgcgctttcaggctggcatacagggcccggccaatcgtggttttgcccgcgcccgacatgccgaccagccagatcaccatgctttcacccctgcttgagtatgttttcgatgttgcgcagcgccagtaccgccagctccgccgagaaaccatagctgggggcgaagtaatggcgacgcaggcgctgacggaccgcggcctgccgttgccagaggctctcgtcccccagcaggtcggccagttgccagcgcgcctcggggtcgaggttgacgatgtcgttgcgcagcagcacatcgggcgattcctcgccggtcagcgcgtcctgctcggcgtccggtacgttcaacagcagcaggttcttgtccaggtacagggcgccgaacgcggttccgccgtagtccgaaaccacatagtcggcgcaacggaacaggctgaggttgtcgtagacgcgggtaatcaccgcagtgaacgcgtattgctcgagcagtttcagcgcctcgggatcggtttcaatcgacagcggatgggtcttcacgatgacgttgtagcgatcgcacaacccggccatggcgtcggcgaagcggctgatcgatgacagctccagccaggtcggcagccacagcacggtctttttcgtcgggtccagggccaggtccgccgggtgctggccttgcagcgaggtttcgcggaaataagcgtcgtagcgcgggtagcccatctggaaagtcacggcgtcgcagcattcgcgcaggcgctcggcctgccaggggccgaagcacaggatcaggtcgtaatgccggttccagctggagaagttgtgtttgtacttgcccagggcgtacatgaagcgcacctgtcgatggcccagcgccttgatcatcggctgcgagccgtggtcgtacatgctgtggttggagaccaccacgtcatagcggtgattggccttgatcacatccaggctgccgtgacagctgtaaccgaggccgccgatgagttcgcggctttgcgcgcgctcttcatgggtgccatgcaggaccacatcgaaagcgtcggcccccaacaggctccagaccgcctgatagtgattgagcatctcggcggtatgaacgaagaaggccaagcggctgaagggttttggcgcggtcatagggctacctggtgcacaacaaagaataagtcgaggcaagcgttggcgttgcttggcggtgtcgtagggcatggctcgcccagagggtggccaggatcgcaaacgctggacatgttatcggcggagcaggcgggaaatgaacgggcagggcggaaaatctttactggcggggccggctcgaccggcggcaggcactgcacggtcgagcctatgcacaagggcgcggtcgaggtggttattgctcgctcgggttgagcttggcttccagctcggcgaccttcgcctccaggctttccaggcgggcccgggtgcgggccaggacgaccatctggctgtcgaattcttcccggctgaccaggtccagcttgctgaagccgctttgcagcagggccttgaactggctttcgatttcggcgcggggcagtggggtatcgccgctgaacaggcgggcggcatggccgctcagggcatcgaggaggtctttgggcgcgagcatgggaagtgtcctgaaaacaatggcgggcagtgtatcacgcactgtctatagtcaattggcaggcggggatgcacgcttttcgcgcatcgcgccgggcagtggcgcaccgttgttgtgcgtatccgtggcgatgatggcgaagtggtttctgtcgtggcgaccaaggaactgaaatcagtgggttttcgcgagatggcaaggtttctgcttagtccccgatgacccatgcactgatgcagtcgttgtgacgaatgcagtgcggcaggcggagcggggaagtgtttcgtcagcagcggttagctggcgtcggtctggtcgaggaaggccgacgatgcgttacaaagccaggcactgcgcttagacttgagtcgggtttgttttcctggggcaagtccaccaattcgggagaaagtttcatgaagctagtcactgccatcatcaagccgttcaagttggacgacgtgcgcgagtcgctgtccgagatcggcgtgcagggcattaccgttactgaggtcaaaggcttcggccggcagaaggggcacaccgagctgtatcgcggcgcggagtacgtagtcgacttcctgcccaaggtgaagatcgacgtcgccatcgacgacaaggatcttgatcgggtcatcgaggcgataaccaaggccgccaacaccggcaagatcggtgacggcaagatcttcgtggtcaatctggaacaggctattcgcatccgtaccggcgaaaccgataccgacgccatctaagccgccccaaacccaacgccccaggagaaaacaatatgactctgcgtaaaatcgcagggctaggagccctgttgtccctcgtaatgcctggcctggccatggcggcggacgaagtggcagccccagtcctcaattccggcgacaccgcctggatgctgacctcgacggccctggtgctgttcatgaccattcccggcctggcgctgttctacggcggcatggtgcgctcgaaaaacattctttccgtgatgatgcagtgcttcgccattaccggtctgatcagcatcctgtgggtcatttatggctacagcattgcgttcgacaccaccggcatggagcagggcgtcgtcaacttcaactccttcgtcggcggcctgggcaaggcgttcctggccggcgtcaccccggcgagcctgaccggcccggcggcgctgttccccgaggcggtgttcatcaccttccagatgaccttcgccatcatcaccccggcgctgatcgtcggtgccttcgccgagcggatgaagttctccgccatgctgatcttcatggccatctggttcaccctggtctacgcgccgatcgcgcacatggtctggtccggcaacggcggcctgatgtgggactggggcgtactggacttcgccggcggcaccgtggtgcacatcaatgccggtatcgccggcctggtggcctgcctggtgctgggcaagcgtaaaggcttcccgaccaccccgatggcgccgcacaacctgggttacaccctgatgggcgcggccatgctgtggatcggctggttcggcttcaacgccggttccgccgccgccgccaacggcaccgccgggatggcgatgctggtgacccagatcgccaccgccgccgcggcgttgggctggatgttcgccgaatggctgacccacggtaagccaagcgccctgggcatcgcctcgggtgtggttgccggcctggtggcgatcacgcctgctgctggcaccgtaggtccgatgggcgccctggtgatcggcctggcagcgggcgtggtgtgcttcttctgcgccaccaccctgaaacgcaagctgggctacgacgactccctggacgccttcggcgtgcacggtatcggcggcatcctcggcgcgatcctcaccggcgtgttcgccgcgccatcgctgggcggcttcggcaccgtgaccgacatcgccgcgcaagtgtggatccagtgcaaaggcgtgggcttcacggtgatctacaccgcgatcgtgaccttcatcatcctcaaggtgctggatgtggtcatcgggctgcgtgtcaccgaggaagaagagtcggtcggcctcgacctggcgcaacacaacgagcgcggttacaacctgtaatctcgcctgaaaaaaatgcccggcttgccgggcatttttttgtctgcgttttgtcattgagagacagctgaaaggttttttccagagcgtgtcagccagtttgatgactgcttttttttcgggtcaatgacttacagcattggaggaatattcggcactttgttttttcccagagcgcgctagaatgcgcgccgaatgtgcggagaactgtatgtggcaacagactctgattaccctgcgggcaaggccccggggctttcatctggtaacggacgagttgctcgccggcctgcctgaactgaaggcatgtcgggtcggtctgttgcatttgtggctgcagcatacctcggcctcgttgaccatcaacgagaatgccgaccctgcggttcgtcgtgacttcgagcgtttcttcaactccctggtgcctcaaggcatggccgggtatgaacatgacgacgaagggcccgatgatctgccggcgcacttcaaggccagtttgctaggctgtcaattgagcttgccggtctcggcgggtcgcttggcgttaggcagctggcaaggcgtttatctgggcgagcatcgcgatcatggcggtgcccgcaaagtccttgccaccttgcacggtgataaggcataagccgctggttatcagtggatgttgatttttttccagcggccttcgacagtcggctcagctgggctataactaatctgcttttcgcaagtcatgaggtagaacatgagcgacgatgatctggaaaacgacgacctcgaagtaggcgacgaagacgaaaccgaagaaggtcttgaagcggccgccgacgatgtggcggaagacgacggcagtgatgttcctgccccgaccgccaaaggcaaggccaaggctgccgtctcggtagacgagctgccgagtgtcgaagccaagaacaaagagcgtgatgcactggcgcgcgccatggaggagttcctggcccgtggcggtaaagtgcaggaagtcgaggccaatgtggttgccgatccgcccaagaagcctgataacaagtacggtagccggcctatctgagcgcctgctacttgcttgctgaaaaagcccgccgtcgctgcgggctttttcatgggcgcctgttggcgagagttcggtgttgcagtgattgcgacagcgtccgatcaggcgccgctgtgccagcgcgccagcagttttggcagctcggtcaggctgcggatttctgcatccggcagccggtccgcctcccaggccttgccggccgggttgaaccagatggcccgcaggccggcctgctgcgccccggcgatgtcgtcgcccgggtgatcgccgatgtgcacggcggtgtctggcgtggcttcgccccgttgcagggcctcgtgaaacagccgtgcatcgggcttggcgatgccgatgtcttcggcgcacagggcgaacttgaaataatccgccagccccaggcggcgcacgtcggcgttgccattggtgaccacgcccagcgcgaagtggttggccagcgcctccagggtcggcagcacctcgggaaagatatccagctggtgccgcgcatgcaggaacacttcaaaaccctggtcggccagggcattggcctggccctggtcgtagccggcttcctccagcgcatgaaacagcacccgccggcgcagcgcgctgatgcggtacttgagccccggctcgttgttcagcacacgctcacggatggcccagagatgctccaccggtacgccgcccagctgcggggcatggtcggtcagccactggcgcagcacggcttcggcactgacgatcacgggcgcggtatcccacagcgtgtcgtcgaggtcgaaggtgatcagcttgatcgtcattactcaccgcctttgttgcgtttggcccgtgggtgggcgctgtcgtagaccgctgccaggtgctggaagtccaggtgggtatagatctgggtggtcttgatatccgagtgccccagcagttcctgtaccgcgcgcaggtcctgggaggattccagcatgtggctggcgaaggagtgtcgcagcatatgcggatgcaggttctgtcccagctcgcgctcgccggcggccttgacccgcagctggatcgcccgagggcccaggcgccggccttgctggctgacgaacaccgcgtcgtccggcggattgctcagcgcccgtagcggcagccacagctgcagcgcctcgcgggccttcttgccaatcggcaggacccgggtcttgctgcctttgccgtggacctgcaccaggccatcggccaggtccaattgttcgaggtcgaggctggtcagctccgacaagcgcagcccagaggagtagaacagctcgagaatcgcctggtcgcggtgcgcgaggaaatcgtcctccaccgcgccatcgagcaattgcagggcgcgatcggtgtccagggtcttgggtaggcggcgctcgcccttgggcggcgccaggccgttggccgggtcgtgattgcacaggccttcgcggttcaggtagtggtacaggccgcgtacggcggagagcaggcgcgccaggctgcgagaggattggccctgctggtgcaggcgcgcaatcatgctgcgcaggccctggatgtccaggtcggaccagctgcaaacctgctgcttggcacagaaggccagcaccttttccaggtcgcggcggtaggcttgcagtgtatggggcgacacttggcgctcactgcgcaggtgctcgcagtaggcgtccagttgtcgttccatggtcagcgaaccgagcgtagcgagtgagtgaagcgcggcagcacgcggcccatgacttcggcgatatagctgaggaacagcgtccccaccgagcttttgtagtgctgcgggtcgcgactggcgatggccagcacgccgtgaatgccctgatgggcgatggcgaccacggcgctcgagccgatctgcaggcgctgctcttcgccgaacaggaagtccagctcatgctcgcgcaggctgccgctgacgctcttgccttcggtcagcaagccgccgatggcggtctgggcatcggccgcggtgacccagcggcccaccggcatggcactgtcactgaacaggatcaggctcacgaaaggcacctggaagtcctggcgcaggctgtcttcgacgctcatcaccacgtcttccaggctgttggcatccatcagcgcgagaatcaggcgccgggtcttctcgaagagccggtcgttgtcccgggccacgtccatcaactgcgaaagccggtggcgcatctcgatgttgcgctcgcgcaggatcttcatctgccgctccaccagcgagatggtgtcaccgcgctgatggggaatgcgcaacgccgggagcagttcttcatgctcgacgaagaagtccggatgagcctccaggtacgcggcgatcgccgccgcctcgaggttttcggcaggagattcgtcgggctgttcggctggaacctgaggctgatcagtcatggttttcgctcattcaaagacgcacctgtccttcgtatacgcgcactgccgggccggtcatcttcaccggttggccagggcctgcccattcgatggacaggcgcccgcccggcaggtcgatcaatagcggcgaatccatccacccctggctgatcgcggccactgcggcagcgcaggcgccggtaccgcaggcctgggtttccccggcgccacgttcccagacccgcagctgcgcgcgctgacggtcgatgacctggatgaagccgacattgacccgggccgggaagcgcgggtgatgttcgatcttcggccccagctcatgcaccggcgcgctgttgatgtcgttgacccgcagcaccgcatgggggttgcccatggacaccgcggccaattcgatggtctggccatcgacttcgacctggtaactcagggcctgggccggtgccacgaacggaatctgctcgggcaccaggcgcggcgcgcccatgtcgacgctgatctgaccgtcgttgcgcacatccagttcgatgatgccgcttttggtctcgacgcggatctggtgcttggtggtcaggcgcttgtccagcacgaaacgggcgaaacagcgcgcaccgttgccgcattgctccacttcggagccgtcggaattgaagatccggtagcggaaatccacgtccgggttgctcggcgcctcgacgatcagcaactggtcgaaaccgactccggtattgcgatcgccccattgcttggcatgtttgggcaggatgtgcgcgtgctggctgaccaggtcgaggaccatgaagtcattgcccaggccgtgcatcttggtaaaacgcagcagcatggttttactccggcagcaggctttcgccagcaaacaactcggctaccgtctcgcggcgacgcacttcaacagcctgttcaccatcgaccagcacttcagcagcgcgaccgcgggtgttgtagttggagctcatgacgaaaccgtaggcaccggccgaatgcacggccagcaggtcgccttcttccagggccagctgacgttccttggccaggaagtcgccggtttcgcagatcgggccgacgatgtcgtaggtacgtgcctggccatcgcgcgggcgcacggcgctgacgtccatccaggcctggtacagggccgggcggatcaggtcgttcatggccgcgtcgacgatggcgaagtccttgtgttcggtgtgcttgaggtactcgacccgggtcagcagtaccccggcgttggcgacgatgaaacggccgggttcgaagaccagttccaggtcgcggccatcgaggcgttcgcgcacggccttgacgtagtcggcggccagcggtggctcttcatcgcgataacgcacgcccaggccgccaccgaggtcgatgtggcgcaggtagatgccgcactcacccaggcggtcgaccaggtccagcagacggtcgagggcatcgatgaagggcgccagggtggtcagttgcgagccgatatggcaatcgacgccgaccacttccaggttcggcagctgtgccgcgcggatgtacacgtcttcggcatcggcgatggcgataccgaacttgttttccttcaggccggtggaaatgtacgggtgggtgccagcatcgacatccgggttgacccgcagcgagaccggcgcgcgaacattcagttcggcggcaacctgttgcaggcgttccagctcgtcgctggactcgacgttgaagcagtgcacgccgacttccagggcgcgacgcatgtcgtcacgggtcttgccgacaccggagaagacaatcttgtcggccgcgccgccagcggccaggacgcgttccagctcgccccgggagacgatgtcgaaaccggcgcccagacgcgccaggacattcagtacacccaggttggagttggcctttaccgcgaagcagaccaggtgcggcatgccggcgagggcatcggcgtacgcgcggtactgcgcttcgatatgcgctcgggaatagacgtaggtcggcgtgccaaagcgctcggcaatggcggacaacgctacaccttccgcgaacagctgcccgccgcggtagttaaaagcgtccatggggttcccttagttggtgtcgtgcttgtgcgactgcgagtgaccttggtcttcaggggatttgctgtcatcgggaagatacagcgggcctttttgaccgcaggcagtgacaaggcaggcaaccgcgacgagcgcagcaagggaagagatcaggcgcttcatggcgaaatccttgagaatgcgttaattgcgcccgagtataccggccacccgacggcttgcctatgcgctggaacacccgtccggcgggcctttgccccgggcacgggcgctgggcgcggcgcccgcggggatattttttctgccgcccgcgcccttggacggtatcctttgcattcgcccggatgcgcccgtatcttgcggcgcttgagcgtgagtagacacttttcgaggttcccgcaatgagtttgactgaagcccgtttccacgatctggtcgatgccacccagcagacgctggaggacattttcgaggagagtgacctggatatcgatctggagagctccgccggtgtgctcaccgtcaagttcgaaaacggcagccaggtgatcttcagccgccaggagccgctgcgccagctgtggctggccgcgcgctccggtggcttccacttcgactacgacgaagaaagcgagcgctggatgtgcgacaagagtgaagagcagctgggcgaaatgctcgagcgcatcgtcctcgagcaggccgatatcaagctcgagttcgaagggctctgagaccgtgacgccaaccgccccggtgcgcccgcccaagccgctgtacagcaatgtcagcccggccgtggcctcgccctgcatcagcctgtgccggctggatgaggaaaaagtctgcaagggctgtttccggcatgtcgaagacattcgcgaatggcgctcggcggacgatgagcgacgacgcgtcatctgtcgccaggcgctggagcgcaagcgggcggcggcgcccggtatgggctagcccgggcacaaaagcccggcggcttgtttatttgtgctgctgtggtagtgtccggttacgcctcgccacatcgaggccagtgaaaaccccgtcttatctggacggggttttgcttttttgtgccgaaaaaaggagtctgcctggatcatgagcaccgcaccttccatcattctcacccgcctcgacgtgcagcgtctggagcgcctgatcgacagcctggacgacacgctgcctggcgtcattgcgttgcagaccgagctggatcgcgccgaaaccctggtgggccacgatgaagtcccgcctggtgtcgtgaccatgaattcgcgtgtgcattgccgcgaagagggcagcggcaaggactatcacctgaccctggtgtatccgcaggacgccaacgccgacgagggccggatctctatcctggcgccggtgggcagcgccttgctcggtttgcaggtcgggcagtacatcgactggccggcgcccggcggcaagaccctgaagctgaccctgctggaagtggaataccaacccgaagcggctggcgactttcacctctgaagggccctgctgaccggctagacctgctcgagcgcgtcgttcaaggcgcgctccaggtcggctttgtagcgcaggtagagattgcttgagctgtggtggtcaccgagcaggccggacaggtccaggttggtgatgtagcagcgatagcgctcggtttcgcgacgctggccgacaatctcctgggcgaccgcggcgaacagctggtcgccatgctccagctcggagaactcccgttgattgcaatacagagtgacctgcacctgccccggtgcggctttgccgatgatgccctgcacgtcataaaaggctttgttcgctggtgtctgtggtgccgggcgtggctcgattcgacgggcccttgtgctgcctgagggcaatatctggtaatacaaaatatccagcggcaccagagcctgggacgcctccatcggcagttgggcatcgcgccggtagaggatcgactgcaggaagcgttgcagggggaccaacaggctctgttcgtcgtggtagggcaggcgttgctgccagagcgcatcgaattcatccagcacatacagctcggcctgagcctcgacgacacggtagaacacctggatgcaatcaggctggcccatcggcaggatcagcgccagatcgtgttcttccagggccatcgggtccaggtgcagcgggctgtagctcgactgttcttcgcccaggtagtcgatcaacgctggcaggcttgccagcgccacatgattgacctggcccggcaccaattccagcacgtggtaatgctgctggacctggatcaggtagcggtggttgagctggctgagcaacaggttctgcgccgtgtcgaacagctcttcgacccgttgggcaatgaactgcgcgcggttgtggcagaagcagcgcactcgcaacttcggttgctcagggccgcgcggcaggttgttgaggtagtcgcgcaggcagtcgagcagggcatgggcgccgtcgtaacggccgactaatacctcgttccagctgttgagcgtcacctggtcgagggtcagcaccaggttctcccgcaccccggcgtagctcaaagagtcggtgcgctcggtggtcatcaggatgttcaggtcgcggtgatgcttgagcgggtcgcggccgacattcactaggatcagcacttcgctgggcacgctgctgtgcagcaggcgttcttcgctgacggtgcccaggggcagggcgatggtctgttgcaggctgcccagcagattgaacagctcgaattcgctcaagtcgctgctgccaggatgcagcgccaggcgcgtgctgctgtcgatcacgccgttgcgatggcaccaggtcaggagctccagcagttcgcggctgcgcttgatcggcgcgaagtgttcccactccagggcagtcaggctgccgttgtacaggccccagtgggtttgccccggttctttcttgttgggcgactgcaccagggtcagggtgtcttcggccaggtccggggcgatgccagggttgatgaattcgatcttgccggccttgcgttcaaaggccgcgtacaggcggcggccgaggatattcaggtcgcgcttgttgaccaggccgagggtctgctcgctacgggcgaactgggtcaggaagcggtagctgtagttcagttcgttgaccagggcccggcgttcggcgctgacctggcggactttccactggctgcggctgtcgagcattgccagctggcgttgatcccagccccattcgtgggccagccgttcgagcagcgagcgctgccagctcgggttgcgcgcgccgttgttgccggtgagcttgcggttgaccttcagatacaggctgcgccgtaccagctccaggcgctccggttcgccacgggccttgaggtattcctcgatgcgccggtagaccacgatgtacgggtccagctcgtcgaggtccaggcgattggcgaacaccgcctgtttgaagcgcaggctcaggcattccacacgcgggtgttcgctggcgtagacctcggtcagcagcagcttgagcaccgacttgtacggcgactcgatgcccttgaacaactgccagagcccggcgccgatgaattcgcccggcggaatatgggccagatggccaaggtcgaggttttcgtcggcagggatgaaacgcttggacagcagcgtatgggtgtactgctggtagcgggcttcttcgtacaccggcaccagccaccacagcggcgtacgcccggccagccagatggcggtgcgatagaactcgtccagcagcagatagtgctgagtggtcccgcaatcgtccgagctcagctgggtgtcgcgatcgccccggataaagcggctcgggtcgatcaggaagaaatgcgcctcggcaccctggctggcagcccaggcttccagcagcaggcatttcttgcgcagttcggcgagttcgttttcgccgagatcgggcgcatggcagacccatacatccatatcgctctggtcagcctgggccagggtgcccaggctgcccatcaggaacaggccatggatagggcgtggtgcgttgccgggccggggcttataggaaaacgaacgggtcaggcgctgggcttcgttgagcgtcggcgtgtcgggttcgtagttcgacagcccggcgggcgtgccgcccgacacataacccggcaataacgggtggttgacgtgaaagaacagcggcaacaggttgagcaccagttgctggcgcggcgacaacccctccatggcccggcccaggcgcccttcgttgagcttcagaaagcgcgcgcgcagctggctgagaaccttgcgatcgattccctcgtccagatctgggcggatttcatgggtgcgggtcattcaaacaggctcgcgaagcttgaacgtgggaggtcttataggtggaggagtttacagccagtcgagggcgagctttaagctgaattttatttttgacgtcagagttccagcgggcaactggagcttgcccacggaatccgacaggcggggattccgagggccgtaggggagagcgttcaggcggcttctttgaccgtcaaaatggtcagcaggccttgggcatgctcagcggcatcgcggcccaggctggtcaggtaaccaccatcgggctgggtaatgagctctttttcgaacaggcgtcgtgcggcggcgatagcttggggggcagcggtctgatggattttcaggccttcctgggaactgtccaggttgaagagtgcaaggatttccagttcggcaaccaactcaggggtatacgacataaggactccagactttctaggaattagacgacagcgtccttaaggtgaccgcagttgggcagcctgtccagtgtccgctgcggacttttacgcccctgggcggcggtatttggccgcagggcgcgtaccagtgtagtcaaggctcgccatcgcgccggccaggggcggacgcgaggcgtggcgggcctatttcttctcgggcggcaactcgggcagggcgcgcagcgcggcttcgtaccattgggtgtcgaacgcgcggtcttcttcgaggatcgcgtcgatttccaccgccaggacgtgagccatgaggttgaggatttcgtcacgctcatagccgaccagggtcagcttgttgaaggtggccttggccgcgggcgggttgtcgctttcgatctggttttcgatcgcttcgatcagggtgttttcggcgaacgcttcttcgtcgctgtcgtcgttgctggtaccgggggttggctcgctcatggcaggctcctcaaggaaaggtcgccagtttacccgtattcaggagcctgatgctgctggccagtcggctgtcgaggatctataagagtggctgccaaccccgcacccggcctggaggctatgtgatgctcaagctttatggattcgccgtcagcaattactacaacatggtgaaactggcattgctggaaaaagatctgcctttcgaagaggtgccgttctacgccgggcaaagccctgaggcgttggccatcagcccgcgcggcaaggtgccggtgctgggggtggagcagggttttatcaatgaaaccagcgtgatcctcgaataccttgaaagccagcctgggtcggcgctgctgcccagtgatccgttcgcgcgtgcccaggtgctggcgctggccaaggagatcgagctttacatcgagttgccggcgcgggcctgttatggcgaggcgttcttcggtatagcggtccccgaggccatcaaggagaagtcccgcaatgagctggtgctgggattcgcctcgctggccaggcacggcaagttcgccccttatgtggcgggcagcagcctgagcgtggcggacctgtatttcctgtacagcgtgagcctggcctgcgcggtagggcagaaactgttcggtgtggactatctggccgagataccggcagccaaggccttgatggcgcgcctggagcagatgcccaatgtgcagcgggtcgcggcagacaaggacgcggcaatgccgcagttcctggcgatgatcgccagcaagaagtaggaaggtttcaggtcactgactgcgggcaagccatgctcttagcaggagcgtggcttgcccgcgctagcttttagcggctgctcagcaacgcctggccgcgaaccaccgccgccttgacctgagccggggccgtgccgccgatgtggtcacgggcgttgaccgagccttccagggtcagcacggcaaacacgtcctggtcgatctggtcgctgaacttgcgcagttcctccaggctcatttccgccaggtccttaccggtttccacaccgtacttcacggcgtggccgacgatctcgtggcaatcgcggaatggcaggccgcggcgcaccaggtagtccgccaggtcggtggcggtggagaatccgcgcagtgccgcttcgcgcatcatcgcgtgcttgggcttgatcgccgggatcatgtcggcgaaggcgcgcagcgagtcgcgcagggtgtcggcggcgtcgaacagcggttccttgtcttcctggttgtccttgttgtaggccaggggctggcccttcatcagggtcagcaggcccatcagggcgccgaacacgcggccgctcttgccacgaaccagctccggaacgtccgggtttttcttttgcggcatgatcgagctgccggtgcagaaacggtcgggcagatcgatgaactggaactgcgcgctggtccacagcaccagctcttcggagaagcgcgacaggtgcatcatggccacgctggcggcggcgcagaactcaatggcgaaatcgcgatcagacacattgtccagcgagttgccaccgacggcgtcgaagcccagcagctggcaggtcagctcgcggtcgatcgggtaggtggtgccggccagcgcggcgctgcccagcggcatgcggttggtgcgcttgcggcaatcgaccaggcgctcgtagtcgcggctgagcatctcgaaccaggccagcatgtgatgaccgaaggtcacaggctgcgcggtttgcaggtgggtgaagcccggcatgatggtgccggcttcgcgctcggcctgctccagcaggcctttttgcaggcgggtgatttccgccaggatcagatcgatttcgtcgcgcagccacagacggatatcggtggccacctggtcgttgcggctgcggccggtgtgcagcttcttgccggtgacgccgatgcggtcggtcaggcgtgcttcgatgttcatgtgcacgtcttccaggtcgacgcgccagtcgaaggtgccggcctcgatttcgccctggatggttttcaggccgtcgatgatgctgtcgcgttcggcatcggtcagtacgccgaccttggccagcatggtggcgtgggcgatcgagcccatgatgtcgtgacgatagaggcgctggtcgaaagtgacggaggcggtgaagcgggcgacgaaggcgtcgacgggctcactgaagcggccgccccaggactgattggtcttgtcagtgctcatgaattcgctcgtgatcggctggaagggaaatgaggtgaaaagttgccgcggataataacagggttgccaatcctgtagctggcaccggtcggcaggtttttatttctgccatgggggccgcgggcgcttgtcgccgacctcgggcgcgcagagactaggcgagcgaaggcgggctactaggagtgatgtaacgatatttatcgatagagcaatatcgtcttggcaaccgtctacagttggactgaaggaacagcgcaatcccggatgtttcatcgagtctggtcgctgatcacgcaaccgttgtcgcatgcgctccggtcccgccgccacctcgcgattcgcgagggaggcggtcggggtggaagccgactataagagagggggtgtttgtgtcctgtatcagcagtccccatgaccatgtcgtgcagtggcgggccttgaacggtatcgagcaggcccgggtaaataatggtgcccgtcgtggggcactttttggccctcgcactagtcttagcgtggatcgccgtgacggacgtcacttcacctgtctacgctatccttgtgcgagactcacgcaggaatccagcgcaatatgaatgtcctgatcgttgatgacgaacccctagcccgcgagcgactgagccgcatggtcagtgagcttgagggatacagtgtcctggagcccagcgccaccaatggcgaagaggcattggccctgatcgacagcctgaagccggatatcgtgcttctcgacatccgcatgccgggtctcgatggcctgcaggttgccgcccgtttgtgcgagcgcgaagcgccgccagccgtggtgttttgtgccgcccctgatgaattcgccctcgaggcttttgatgtcagcgaggtaggtcacctgctcaagccggtgagttccgagcatctgctcgaggcgctgaaaaaggccgaccgccccaaccgggtccagctggcggccctgacccggcccgccgcggaaagcggcagcggccctcgcagccatatcagtgcgcggacccgcaaaggcatcgagctgatcccgctggatcaggtcgtctatttcattgccgaccacaaatacgtgaccttgcgccatgaaagcggcgaagtcctgctggacgaacccctgaaggcgctggaggacgagtttggcgagcgtttcgtacgcatccatcgcaacgccctggtggcccgtgaacgcatcgaacgcctgcagcgtacgccgctggggcatttccagctgttcctcaaaggcctcaatggcgatgcgttgatcgtcagccgacggcatgtggccggcgtgcgcaagatgatgcagcagctctagatccgggcggccgggcgggtcatgcgccccgccgcaatgttcctgcagccagggaggggctgtagttcctgatacaagtcaaagctgatttggctgagctgttatcatctgccgtattttcatcagtacggattgatccatgtcctctcgcgaaatccgcatcgctacccgcaaaagtgccttggccttgtggcaagccgaatacgtcaaagctcgtctggaagccgctcacccggggttgatcgtgacgctggtgcccatggtcagtcgcggcgacaagctgctcgactcgccattgtcgaaaatcggcggcaagggactgttcgtcaaggagctggaaaccgcgctgctggaaaacgaagcggatatcgccgtgcattcgatgaaagacgtgcctatggacttccccgaaggcctgggcctgttctgcatctgcgagcgtgaagacccgcgcgatgcctttgtctccaatacctattccagtctcgacgatctgcccgtgggcagcgtggtgggcacctccagcctgcgtcgccaggcgcagttgctggctcgtcgttcggacctgcagatccgcttcctgcgtggcaacgtcaacactcgcctggccaagctcgatgccggtgagtacgacgccattatcctggccgctgcgggcttgatccgtcttggctttgaagatcgcatcagctcttcgatcagcgtcgacgacagccttccggctggcggccagggcgcggtgggcatcgaatgccgcacggccgacagcgagatccataagctgctggcgccgctgcatcatgtcgataccgcggatcgagtcaccgccgaacgggccctcaacaagcatctgaatggtggctgccaggtaccgatcgcctgctatgcggtacttgaaggcgatcagctgtggttgcgtggcctggtcggcgaaccgagcggcggtgtgctgctcagcgccgaggcccgtgctccacgtagcgcggcggcggcgcttggggtgcaggtcgcggaggatctgctggcccagggcgccgacgatattctgcgcgcggtctatggcgaggctggcgaagagtgagcgactggcgtgtgctgctgacccggcccgcggacgagtcggcgctgctggctgaggttctgggcgaagcgggggtgttcagcagcagcctgccgttgctggaaatccaagccctgccttttggcgatacccaacgcgccaaagtgcttgatctgcacctgtactgtgcggtgatcgtggtcagcaagccggccgcgcgaatggccgtgcaactgctcgagcagttctggccgcagccgccgagccagcgctggttcagtgtgggcgccggcacggcgcagattctggccgatcacggcctggatgtttttttccccgagcaaggcgatgacagcgaagccttgcttgaacttccccagttgcgcgaggctattgcacggcccgaccctcgggtgctaatcgtgcgcggggagggtggccgcgagctgctggctgagcgtttgcgcggtcaaggtgctagtgtcgattatctggagttgtaccgccgcgacctgccgcgttatgccgacggggtcctgatgcaatgcatccaggcggaacgcttgaatgggctggtggtcagcagtgggcagggtttcgagcacttgcggcagttggccggcgaggcctggccacaggtggcgcgactgccgttgtttgtaccgagcccccgggtcgccgagatggcgcgtgccgccggggccgagaaagttgtggattgtcgtggcgccagcgccgcggccttgctaacggcgctacgggagcaacccgtgcccgttctctaaacgcaaaggatggatacgtgagcgaaacagccttgcctaaagatgatgtccagccggtagtcgatgcaccggctgaacccgcaacccctgctccgcagcgccgtggcaacgggttggtgatcctcgccctgctgctgggggcggccggcgtcgctgccggcggctggggtgtctggcaggtgcgcagcctgcaggccaacaatcaacagcagctggggcagttgcaggccctgggtgatgaggcgcagagcctgaagctcaacgagcagcgcctgacggcgcgtctggagcagttgccggcggccgatgagctggaagagcgtcgccgtctcgtcgcgcagttgcagggcgaccagcagcgactcaatcagaagctcgagagcgtgctgggtgccagccgcaaggactggcgtctggccgaggcggaacatctgttgcgtctggccagcctgcgtctttcggccttgcaggacatcagcagcgcccaggccctggtgcagggtgccgacgagatcctgcgcgagcagaacgatcccggttctttcgccgcgcgcgagcagttggccaagagcctcgcggccctgcgcagcaccgaacaaccggatcgcaccgggctgttcctgcaactgggcgcactgcgcgaccaggtgaccgagctcaccgagctggccccggagtaccgcgaccgtggcgattcgttgctgggcctgaccgccgacggcgacggcgccagccgctgggcgcaatggtgggaccagatctcgcgctacattcgtatcgatttcaacgcggacaagaatgtgcggccgctgctcgccggacaaagcctgacgcaggtgcgcctggccttgagcctggccctggagcaggcgcaatgggcggccctgaacggccaggcgccggtgtacacccaggccctggcggaagctcgcgacgtgttgaagggcaatttcaatcaggacaacccgcagagcaaactcatgctcgagcgcgtgtccgagctgagcaaacagccggtcactgtgcaaacgccggacctggccaagaccctgagcgccgttcaggcctacctggagcgacgcaacctgagcgctgaagagtcggtgaaaccactggccaaacctgctgcgaatgccccgcaggagaccagtccatgaagcgcctgtacgtgattctgttcctggtgatcgccgcctcgggattgctggggttggcgattgccgagcactccgggtacatcctgattgcctacgatagcttccgttatgagtcgagcctgtgggcgaccctggcattgatcgcggtgatctggctggtgatctggggtatcaaggcactgatcgaactggtgatggcctccagcggcgtggtcaatccctggtcgcggcgcaaccgcagccgtcgcgtgcagattgccatcgaacaaggccagatggatcttgccgaaggccgctgggccagcgcccagaagcacttgcatcgtgccgcggaagccgagcgccagcctcttttgtactacctcggcgcggcgcgggcggcgaacgagcagggaaactacgagcagtgcgacagcctgctggaacgtgccctcgagcgccagccccaggctgagttggcggtggccttgagtcatgcccaactgcagaccgatcgcggtgataccgacggcgccctgagtaccttgcaagccatgcacgagcgtcatccgcacagtgttcaggtgctgcggcagttgcagcgtctgcaccagcagcggggcgattggtcggcggtgatccgtctgctgcccgagctgcgcaaggacaaggtcctgcccgccaacgaactggccgagctggaacgtcgggcctggggcgagaacctgaccctcgcggcgcatcgcgaagaggacggtacggtcggcctgcaatcgctcaaccgcgcttggcagcaactgaccgcggctcagcgtcaggagccgcagctggtgctggcctacgccgaacaactgcggcaattgggcgccggggccgaggccgaagaagtgctgcgcgtcgctctcaagcgcaagtacgacagccatctggcgcggctttacggcttgctgcggggcagtgacccggcgcggcaactgcagttcgccgagcagtggctcaaagaccacccgaacgatccgagcctgctgctgaccctgggtcgcctgtgcctgcaaaccagtctctggggcaaggcgcgggactacctggaaagcagcctgcgcctgcagcgcaaccctgaggcctgtgccgagctggcccggttgctggcgcaactgggcgataccgagcgcagcaaccagctgttccaagaaggcctggggctgttggacgagcgcctcctggcatcgccgctgccggtgcccgccagggtataaacccgcaagactgggccgtccccggaggggcggcccgtcccgtgactccccccgatctggcctctgtgccagtttgccgcgctcgatcttgtcatggcgcgccttgaaagggccgagcgctttctctaccgtggcagcctgtttcttccgttgtggatacaccatgtcgctggccggctcacgcttgctgttctcccttgtgttttttaccggtgccttggccctgtgggcttcgtttcacctggagttcgggattgggctcgagccttgcctgttgtgggtggcgcaacgtttcttcgtgttgctgttgacctcgatcagcctggtcgcggccctgcaggggccacaatacccggcgagtgccctgtactggctgctggaactgctctgcagcctggcgggtgtggttacggcagggcgccatgtgctattgcagaacattccttcggatcagttgctggcgtgcttgccggacatgccgttcatgctcggcaacctgtcctgggggcgtgccttgcagctggttttcaccgggaccgcgcagtgcgcggaggtctcctggacgttgctggacatgagtgccgcggagtggagcctgctgtttttcatcgctgtgatgattttgagcgcctatcgtctggtgcggcttctaccatggggccggcgcagggcggccgcgacctgaatcggcgatttgcgatgggacgcaagattaaacacttgtatgaactttatctcctgcgtaccttgaagcggctgtcgagcgggcataatctggcccgcacgtgtcaccgcaattacgttgctcgatgctgttctgcctggccggatgctgatgttcagtccagtggcggattcagagcggcatgacccataagggaagagagatcgccatgctcgaaagttgtcagaatgctcaggaacgctggggtggagtgcatctgctgatcgatcgctggttgcaggagcgtcacgaactggttcgggcctatgatgctctcggcgcggagcctgagacgctggctgaaaatcgacagccgctgcaggagttctgcgcaatcctggtggactacgtctccgccggccattttgaaatctacgagcagttgaccggcgaggccaaggccttcaatgaccagcgcgggctcgaactggccgaaaccatttatccacggatcgatgtcatcactgaaaagctgctggcgttcaacgatctgtgcgacgaaggaaaatgcgtggcggagaagttcaaggagctgggtggtctgctgcatgaacgcttcgagctggaagattgcctgatcgaagtgctgcacaacgctcacaaggaagaggccgccgttcaggcctgacttgcagcgaaagctttaccgaaacggtgcgcattgcgcaccgtttttcgtttctgcgcccccctaaccggtagcccccagcagctcgatttcaaacaccaggggggtgtaaggcgcgatcaggtcgcccgcaccgtcggcgccgtaagcctgggccgaaggaatcaccaggcgccacttcgcccccgtcggcatctgttgcaacgcgctgcgccatccggcaatcacactgtccaggcgaaaccattgcggctgctgattctgatcgaacactgtgccgtcaggcaggcgtccggtgtagcgaacctgtaccgaaccattggctcccggccgtattccgttgccgggtgccagctcggtcagcaggatgccgttctccagttcgcgtacccccggcttggccttttcggcagagagaaagcgctgttcgttttccagcgccacttcgattcgcggcttgtccgcttgctcgccgacctgtgcttcatgctgggcgaggatctgttcgatacgctcgtccttgagtgccaggggcttgccttggtaggcctgtttcaagccctccaccaatgcctggatctgcaggtccggcacctcctggcgcaggcgctcgccgaggctggcgcccaggctgtaggcgagatcgtgggcatcgtttttctgcgaatcttcggcggcctgagccagtggcaacaacatacacaaggataaaaaaaggtaacgcgacatgggcgttctccggcctgagacgaggtggattatgccagcgtggatgtggtggctggtgagtaactttcttgtgcgcgaagaacattttcgatcctctgcaacgcatggcattcgatactgtcaacatgccctagcggcggtagcagcagaggtctagtatgagccgcaactcacgtcagccaggaggtaaaccatgtcggccaataagaagcctgtaagtactccgttgcatttgctccaacagctttcgggcagcctgctcgagcacttggaaaacgcttgttcccaagccttggctgatgctgaaaaactgctcgccaaactggaaaagcaacgcggtaaggcacaggaaaaactgcacaaatcgcgcaccaaattgcaggacgccgcggcggccggcaaggccaaggcacaagccaaagccaaggacgcagtgaaagaacttgaagacctgctcgatgcactcaaggcacgtcaatccgaaacccgcgcctatattctgcaactcaagcgcgacgctcaggaaagcctgaaactggcccagggcgtcggtcgtgtgaaagaagccgcagccaaggtgctgagcactcgctccgccaaaccggccgccgctccagcgcagaaagcggcagccaagccgacggcaaaagccccggccaaacctgccgctaaagcaccggcaaaagctgccagcaaaccggctgccaaacctgccgccaagccagtggcaaaaaccgctgcagccaaacctgcagctgccaagccagcggctaaaccggctgctgcaaaagcacctgcgaaacctgctgccaaacccgttgcgaaaacggcggctgccaaaccggctgcagcgaaacccgctgccaagccagcagcaaaaccagcggccaaatccgccgcggccaagcctgctgctgccaagcctgcggctaaaccggtagcggcaaaaactgctgcgaaaccggccgccaaaccggctgcggcaaaagctccggtgaaggcagcagcgaaacccgcggccaaaccggcagccaaacctgcagcagccaagccagcggcttccactgccgccaagccagcagccgctaaaccggctgcagcaaaacctgccgccaagcctgcggtgaaacctgctgccaagccggctgcaaaacctgccgcgaagaagccagtcgtcgccaagcctgctgctgccaaaccggccaccgctccagcggccgccaaaccagccgccccggcaactccggcagccaagcctgcggcaccggtctcttcgccagctccagcggcgactgctgcgccagctccggctccgactgccgttcccgccagcaccacgccaaccagcgcttcctaagcgtcggtcaccgcgacgcgcagcgcctgcagcgcgtcgcggttgaggttggcggcttcggccgccagtccttccagccagtccgtcagatcctgcgcttcaccctccgaccattctcccgccagcgcctccaggcgcagcagcagttgccgctcggcctccagttccaatgccttgacctgttcgcgcaagatcgccagttccggatccgcgctcgcggccgggcgccattgcgtgcgcagctggcgcagcggcctgacgacttcgtcgtgccagggctggcccagggttcgcagctgttgcaggcgctgcgaagtgcaggccaccccgcgtacgccgagccaggccgcgcagagtagaaggcagacattggccccggccgcctgaaggttcaggcaggcttcttcgacgcccgggcgggcgtaggtcttgagggtgaagctccacaggtcagaggacatagtgctactcgcgccagttgcgaacgaagctggtagactccgccgccattatgattcgacttcagaacctgactttacagcgtggtccgcaacgtctgctagaagacgccgagctgaccctgcacgccggccagaaagccggcctgatcggtgccaatggcgccggcaaatccagcctgttcgccttgctgcgtggcgagttgcacccggattcgggcgactgcttcctgcccgccgactggcgcatcgcccatatgcgccaggaggtcgataccctcgagcggctggcggtcgactacgtgctcgatggcgacctgcgcctgcgccaggtgcagcgtgagctggccgccgccgaagcggcccatgacggtgcggccctggcgcgcctgcatgccgagctggacagcgccgacggttataccgccgacgcccgggcgcgcaagctgctggctggcctgggtttcagcaacgagcagatggaccgccaggtcggcgacttctccggtggctggcggatgcgcctgaacctggcgcaggcgctgatgtgcccgtcggatctgctgttgctcgacgaaccgaccaaccacttggacctcgatgcgatcctctggctggaggactggctcaagggctaccccggcactttgctgctgatttcccacgaccgcgatttcctcgatgccgtggtcgaccatgtggcccacgtcgatcagcgcaagatcaccctttatcgcggtggctacagcgccttcgagcgcgcccgtgccgaacgtctggcgcaacagcagcaagcctacgagaagcagcaggcgcaacgcgcgcacatggaaaagtacattgcgcgcttcaaggcccaggccaccaaggcccgccaggcccagagccggatcaaggcgctggagcggatggaagagctgtccgcggcccacgtcgactcgccgttcgatttcgttttccgcgagtcggaaaagatctccagcccgctgctcgacctgtccgatgcccgcctgggttacggcgagaggactgtgctgaagaaggtcaagctgcaactgaccccgggtgcgcgcatcggtctgctcggccccaacggtgcgggcaagtcgaccctgatcaagaacctctccggcgagctgtcgccgctgggcggccgcctgacccgcggcgagaacaccgtggtcggttatttcgcccagcaccagctggattcgctcgatgccaaggccagcccgttgctgcatttgcagcgcctggcgccgaccgagcgcgagcagaccctgcgcgacttcctcggtggtttcgacttccgcggcgcgcgtatcgacgagccggtgctgaatttctccggtggcgaaaaggcacgcctggccctggccctgattgcctgggaccgcccgaacctgctgctgctcgacgaaccgaccaaccacctggacctggaaatgcgcctggccctgaccatggccctgcaagagttcagcggcgcggtactggtggtctcccacgaccgtcacctgctgaaaagcaccaccgacaacttctacctggtggccgacggcaaggtcgaagagttcgacggcgacctggacgactacgcgcgctggctggtggactaccgccaacgcaacgcgccggtcagcacgaccacggtcaacccggacaaaaccgacaagaaggcccagcgccaggccgccgcggccttgcgccagcagttggcgccgcacaagcgcgaagccgacaagctggaaaccgagctgggcaaggtccacgagcggctggcgaaaatcgaagccagccttggcgacagtggtatctacgaagccgcgcgcaaggacgagctgcgtgacctgctggccgagcaggccaggttgaaggtgcgtgaaggcgagctggaagagtcctggatggaagccctggaactgctggaaagcatgcaggcggaactggaagccttgtcctgatggaagcgttcaagctgcctgtgcctatcacgtgggtcgagccgctgtgggtcaccgtgcaaatcctgctgatcctgttggctggctacatcacccagcgttttgtcgcccgctgcctgacccgcctgggtgaacgttacccgttcccgccgcagctgctgatgccgctgcgcggcggcttgcgctggctgatcatgggcagcgcgctgatcttcgtcctggagcggctcggggtgtcggcgacggtgctctggactgccctgtccggttttgtcgcggtggcggcggtggccttcttcgccatgtggagcgtgctgtccaacctgctctgcgccatcctgatcttcaccgtgggaccgttccgcatcggcgatgtggtcgaactggtggacaccctcgacaagccgggcatcaagggccgggtggtggcaatcaacctgttgtacacctcgctgatcgaggccgaggaagccggcaccggcggcgtcatggtgcaggtgcccaacagcctgttcttccagcgttcggtgcgccgctggcgtggcagcgatgcgctgtcgataggctccggcgagaaatagtccccctgtgccgtctctgtagccgctgccgagcattgcgaggctgcgaagcagacatgctcttgagatcgcaggaagctcctgcggaccttagcgcagccttcggcagcggctacagttggccggcgatgtctgtccgacaaaaatctatggtcatccgtccgccagcgcattagcttaggcgtctacgacgaattcgagccgaggtgtgcgatggttcttgagacatggctggcgttttttgccgcctgctgggtgatcagcctttcccccggggccggcgcgattgcgtcgatgtcctgcggtctgcaatacggtttctggcgcggttactggaacgccctgggcctgcaactgggcctggccatgcagattgcgattgtcgccgccggcgttggggcgattctcgcggcatcctcgaccgccttttacgcgatcaaatggttcggcgtggcttacctggtctacctcgcggtcaaacagtggcgcgcgctgcccagcgacctgagcgacgacgccgcgatccggccgatcggcaaacccctggcgctggtgttccgcgggttcctggtcaacatcagcaatcccaaggcgctggtgttcatgctggcggtcctaccgcaattcatcgatccccacgcaccgctggtgaagcagtacctgatcctcggcgcgaccatgattgccgtcgacctgatcgtcatggccggctacaccggcctggcctccaaggtcctgcgcctgctgcgcacgcctacccagcaacggcgcatgaaccgcaccttcgccggtctgttcctcggcgccgccgggttgctggcgaccattcgcaaagcgccggtctaagaggctggtcacagcaaaaaggcgcccatcgggggcgccttttttgtacgtgcccctcaggggacccgagagcatgggctagtcccgaccacgcccggatttatttcatctttgttcaggaaaccccggaccccaggcgattcaaggctttggcccggcacgaggcacgactgcgcctgggtgtcgcgtgtgacaacgcttgagtgaaactcattggaagtgaacaatgtgttacttcgtatttccatttgagattcgttcatgactgccccctcccgtttcctggcgtggctcgtgctgccggtattggccctgtgcagcgccaacctgctggcggacaccgtagaaggcgcgcccaaggcgctgcacctgctcgactacattggcgcggactatccaccgacggtcgaggcgggcaaggtcattgatgactccgagtaccgtgagcaggtcgagtttctcggcgtgttgcaggggctggtcgccgatttgccggccaagccggagaaggccgagctggagcagggcatcgccagcctgaacgacgcggtcaaggccaaggcggacggcgccctcgtcgcccgtcaggcgcggcagctgggagcccggctggcggtggcgtatgaggtcagccaggcgccgatcatcaccccggacccgagccgtggcgcacctttgtatgcccagcattgctcggtgtgtcacggcgacaccggtgccggcgacggcccggccggtgtcggcctgacgccgccaccggccaacctgcgggatgcggcgcgcacggatcacctgagcctctacgcgatctacaacaccctcggcctgggcgtcgaaggcaccgacatgccgtctttcgccgatcagctggacgaccgccagcgctgggacctggcgacctatatcgccggcttcaccgccgacccggccgcggcgaagggcgacaagagctacaacctcgccgacctggcccgccagaccccaagtgaagtagaggccgccgaaggcccgcaggccgcggccaccttccgtgcccagcgcgcccagccgccacaggtcaagcgcggcccggcgcaactgctcgactacaccgcctcgaccctggacaagagcctggccgcctaccgcgccggtgaccgcgaacaggcctacgacctgtcggtggcggcgtacctggaaggcttcgagctggtggaaagctccctcgacaacgtcgatgccaatgtgcgcaaggacaccgagaaagccctgatggcctatcggcaggcgttgcaggacggcttgccggcagagcaggccgagcagcgtctggctgccgccaaggccaagctgacagagtcggcgggcctgctgggcagcgatggcctgagctggtccctgagctacatttccggcctgctgatcctgctgcgcgagggcctggaagcgatcctggtgctggcggcgatcctggccttcctgcgcaataccggccagcaatcggcggtgcgcagcgtcaacgtcggttgggggctggcgttgctggccggcctggcgacctgggcgctggcggcgtatgtgatcgacgtcagcggctcccagcgcgagttgctggaaggcgccacggccttgttcgccagtgtcatggtgctgtggctcggcgtgtggatgcacgaccgccggcacgcggcggcctggcaggactacatcaagagcagcctggtgggcggtggcggccgtttcggttttgcggtgctggcgttcttctcggtctatcgcgagctgttcgaagtgatcctgttctacgaaaccctgtggctgcaggtcggcccggcgggccacaacgcagtgctggccggcggcgccacggcgctggtgctgctggtcggcctggcctgggtgatcctgcgcggttcggccaagctgccgctgacgctgttcttcggcatcaacgcggcgttgctgtgcgccttgtcggtggtgtttgccgggcatggcgtcaaggcgctgcaggaggctggaatcttcggtacgcggccggtggcgttcttcgacttcgactggctgggcattcacgccgatgcttactcgctgacggcacaggcggtggcgatcgtggcgatcatcgtgctctacagtcgcagccgcatcgccgagaaacggcgggcccaggtttcctgaggcatccgcttcgctcattatcgcgggcaagcttgttcctacggtgcatcgagaactgtaggcgcgaggcttgcccgcgatgcttttcaggaggagtcacgcaatgcgtgtgtggatcgatgccgacgcctgccccaaggcggcgaaggatcaggtggtgaggtttgccctcaagcgccagttcgagctggtgctggtggcggggcagccgcagataaagccggcctttgcctgcgtcaagctgatcgtggtgcccagcggcccggatgcggctgacgattatctggtggaacacgcagtgccgggtgaactggtgatctgcagcgacgtgcccctggccgaccggctggtgaagaagggcgtcgccgccctcgacccgcggggcaaggagttcgatgcgcagaacatgggcgagcggctggcggtgcgtaacctgtttaccgatctgcgcgagcaggggcaggtcggtggtgggcaaggcccttatggggatcgcgagaagcaggccttcgccaatgccctggaccggatcctgacgcggctggcgcgtcaggcctgacaattcccgcgaggcgagggcgcttgccgctcgccacggcttttgggttattcgtcgttttcgtgggtcagttccagcacccgatccaccagtttattgatgccggccgcggcttcgctgatggactgcgcgagcatgtaggccggggtgctgaccagcttgcgcgccttatcctcgatgatgtcgccgacggtgcactcggcatgggtcgcgcccatcttgctgacggcggccgcggtgtcggcgtcgttgccgatggtgcaggtgacgcccgggccgtagatcttcgccgccaatgccggcgagatgcagatcaggcccaccggcttgccggcttcggcgaaggcttcggtcagcgccaggacatccggctggaccgtgcagccggccccttccacggcgaagttggaaaggtttttcgccgcgccaaagccgccaggcacgatcagcgcgtcgaagtcttcggcgttggcctcgcggatgtctttgacctggccgcgggcgatgcgcgccgattccaccaggacattgcgcgactccggcatctcttcgccggtcaggtggttgatcacatgcagttgggcgatgttcggggcgaagcactgcacctgggcgccgcgctggtccaggcgcagcagggtgatgacgctttcatggatctcggcaccgtcatagacgccacagccggaaaggatcactgcaacttttttgctcatggttttttctccagattcatggcgttaaatgtccactaatttgtcgcccgttgccatagggttatcccgccgcccaacctaatcttcgatcaggattgcgatcaggccgtgtcatgaatttcattctgtatgcggtgccgttcttcttcgtgctgatagccctcgagctgctggccgaccgctggcgggggtgaacaactatcgggtcgcggacgctttctacatggatcgcaactacggcggggtgttcattatttgggtattgggggggcgctggagaatcgcccgtgggcgctgaagatggagctgctgcggctggcgtcgaacctgccgctggtgtggctggcgcctctggtcgggctgtggccggccagcgccttgggctgggtcggcctgatcagttacagcctgctcagtggcgttgcgctttactgctgccggggtcgtcttactcgactggcgtcttagacttgcagcaatcgctctgctcgttctgcttgacctgttcggcttcgtagatcgccttggccagtcgcgcattcttgaagcggcggcgcagccacagggcgaaacccaggaccagcaaggcgccgagcacccacagttcgtacttcttgatgctgcccagcatgccttcgagcacggcgccgaagtgataggccgcggcggccagggcggcggcccagatcgccgcgccaatgccgttgagcaacagataacgtcccggcggataccccgacaggccgatggccaccggcatcacggtgcgcaggccgtagacgaagcggaagctcagcacccagatgtccggatgcttgcggatatgctccagcgcccgatcgcccatcaattgccagcgcggcttgcgcgccagcagcttgcgcccgtgcttgcgtcccaggaagtaccacagctggtcgccggcatagctgccgaagaacgccacgaccaccaccaggttgatgtccatgtatccgcgaaacgcgaggaagccggccaggaccaggatggtctcgccttcgaagaatgtgccgagaaagagggcgaagtagccgaattcctgaagaaattgttggagcattgtctggatgctggcgaaatgaacgcgcagcctaacccttcgggcccatggaggaaagtatccaaatgtgtctcgacgtgaacaaatgctggctggacaatagctgcgactaccggtcacagggttaagcacaactgtcatccgttcgtcataatgggcgcttataactgtcacgctcgcccgcctgtgcgggctcaggagtctgtcgtgagctttaccccagccaaccgtttgtttcccgccactcgcctgcgtcgcaatcgccgtgatgatttttctcgtcgcctggtgcgtgaaaacgtcctgaccaccgatgacctgatcctgccggtattcgtgctcgacggtgagaatcgtcgggaagcggtggcctcgatgccgggcgtcgaacgcctgaccatcgacctgctgctggaggaagcggcgcagtgggtcgagctggggattcccgcgctggctttgttcccggtgaccccggcggatctcaagtcgctggacgccgccgaagcctggaacccggaaggcattgcccagcgcgccacccgcgcgctgcgtgagcgtttccctgaactgggcgtgatcaccgacgtggcgctcgatccgttcaccacccacggtcaggacggcatcctcgacgaagaaggctatgtgcagaacgacatcaccgtcgatgcactggtcaggcaagccctgtcccatgccgaagccggcgcccaggtggtcgcgccttcggacatgatggacggccgcatccaggcgatccgcgaagccctggagctggccggccacgtcaacgtgcggatcatggcctattcggccaagtacgccagcgcctattacggcccgttccgcgacgcggtcggctcggcgctgaacctgggcaaggccaacaaggcctcctaccagatggacccggccaacagccacgaagccctgcatgaagtggccgccgacctcgccgaaggcgcggacatggtcatggtcaagccgggcatgccgtacctggacatcctttggcgggtcaaggatgaattcaaggtgccaacctttgtctatcaggtcagcggcgaatacgccatgcacatggcggcgatccagaatggctggttgagcgaaggggttattctcgaatccttgaccgcctttaaacgcgcgggtgccgatggcatcctgacttactttgccgttcgtgctgctcaattgttacgagagcaaaaatagccctcccaggaacacgcgatgaataccgaaggactcactgaagttgccgtaaaagaagctcaacccgtggtcgagcaggtcgttgaaacaccaccggagctggaagccccgccggtgcaagcggacgcaccgcatgtggcgatgccgaccctggtcatcccgagcctggatgacagcagcctgtatatccatcgcgagctgtcgcaactgcagttcaacatccgcgtgctggaacaggcgctggatgagtcctatccgttgctggagcgcctgaagttcctgctgattttctccagcaacctggacgagttcttcgagatccgcgtcgccggcctgaagaagcagatcaccttcgcccgtgaacaggccggtgccgatggcctgcagccgcaccaggccctggcgcgcatcagcgacctggtgcacggtcacgtcgaccgccagtacgcgatcctcaacgacatcctgttgccggagctggagaaacatcaggtccgcttcatccgtcgccgttactggaccaccaagctcaagacctgggttcgtcgttatttccgcgacgagatcgcgccgatcatcaccccgatcggcctcgacccgacgcacccgttcccgctgctggtgaacaagagcctgaacttcatcgtcgagctcgaagggatcgacgcctttggtcgcgactccggcctggcgatcatcccggcgccgcgcctgctgccgcggatcatcaaggtgccggaagaagtcggcggccctggcgacaactatgtgttcctctcgtcgatgatccacgctcacgccgatgacctgttccagggcatgaaggtaaagggctgctatcagttccgcctgacccgcaacgccgacctggcggtggacaccgaggacgtcgaagacctggcccgcgccctgcgcggcgagctgttctctcgtcgttacggcgatgcggtgcgtctggaagtggccgacacctgcccgaaacacctgtccgactacctgctcaagcagttcaacctgagcgagaccgagctgtaccaggtcaacggtccggtgaacctgacgcgtctgttcagcatcaccggcctggacagccacccggagctgcaatacacgccgttcaccccgcagattcccaagctgttgcagaacagcgagaacatcttcagcgtgatcagcaagcaggacatcctgctgctgcacccgttcgagtccttcaccccggtggtcgacctgctgcgtcaggcggccaaggatccgcacgtgctggcggtgcgccaaaccctgtaccgctctggcgccaactcggaaatcgtcgatgcgctggtggatgcggcgcgtaacggcaaggaagttaccgcggtgatcgagctgcgcgcgcgcttcgacgaagagtccaacctgcaactggccagccgcctgcaagcggccggcgcggtggtgatctacggtgtggtcggcttcaagacccacgccaagatgatgttgatcctgcggcgcgaagccggcgagatcgtgcgctacgcccacctgggcaccggcaactaccacgccggcaacgcccgcctgtataccgactacagcctgctgacctccgacgacgccttgtgcgaagacgtcggcaagctcttcagccagttgatcggcatgggcaagaccctgcgcatgaagaagctgctgcacgcgcccttcaccctgaagaagggcatgctcgacatgattgcccgggagacccagttcgccctcgacggcaagccggcgcacatcatcgccaagttcaactcgctgaccgatccgaagatcatccgcgcgctgtacaaggccagccagtcgggcgtgcgcatcgacctggtggtgcgtggcatgtgctgcctgcgtccggggatcgccggcgtgtcgcacaacattcatgtgcgctcgatcatcggccgcttcctggagcacacccgggtgttctacttcctcaatggcggcgaggagcagatgttcctctccagcgccgactggatggagcgcaacctcgacaagcgcgtcgagacctgcttcccggtcgagggcaagaagctgatcctgcgggtcaagaaggagctggaaagttatctcaccgataacacccacagctggagcctgcagtcggacggtcgctacatccgcaacaccccgaccggcaaccagaacccgcgcagcgcccaggctacattgctggagcgcctgagcaacccggtgctggcggtgcgctgagcccggggcttaattcagcccatgaaaaagccggcttgccggcgatggcgccctttagaaggagcccatcgccggcaagccggcttttttgtgcggggcgtttcagtgcacgttgagggtgatcccgacccgggtcagccactcggcttccagggcgaagtcggcctgggtcagctggttctcgtccagccagtttgccgggaacatcacctccaggctgtcgccggcggcgtgcagcttcacctggggcatttcctgggtgccgcggatgtggtggaacaggatggcgaaacgcagcagcacgcacaggcggatcagcttgctgccttcctcgccgaattcggcgaacttgtccttgggaatgttgcgacggtggccgcgtaccagtagcgcgagcatttgctggtcttcgcgggagaaaccggcgaggtcggagtgctcgatcaggtaggcgccgtgcttgtggtaatggtagtgggcgatatccaggcccacttcatggaccttggcggcccagcccagcagttcgcgccagacgccgtcctccaggtcccagtcctcggccacttggtcgaaggcgtggagcgccttgcgctcgacccgggcggcctgttccaggtcgacgtgataacgctccatcagcgagcccagggtgcgctcgcgcacgtcttcgtggtgatgacggcccagcaggtcgtagagcacgccttcacgcagggccccttcgcaatggtccatgcgctgcagttcgagggcgtcgaagatggcttcgagaatcgccaggccggccgggaagatcgcccggcggtccggcttgatgccttcgaagtcgattttctcggcatcgcccagcttgaacagccgacgcttgagccaggcgaggccttcggcgttgacttcaccgctgccgtggccgccggccttgagcgccaggccgatggcgcggatggtgcccgaggagccgatggcttcatcccaggtcaggcgatgcagggcgtgttcgatgctcatgatttccaggcgcgccgcggtgtaggcctgggcgtagcgcgccggggtgatcttgccgtcgcggaaatagcgctgggtgaagctgacgcagcccatctgcaggctttcgcgcagcagcggctcgaagcgctggccgatgatgaattcggtactgccgccgccgatgtcggcgaccaggcgcttgcccggggtatcggcgagggtatgggacacgcccaggtagatgaggcgggcttcttcacgaccggagatgacttccaccgggtggccgagaatctcctcggcgcggcggatgaattcgccgcggttgcgggcttcgcgcagggcgttggtgccgacgatgcgtaccgcgcccaggggcatgccgttgatcagttgggcgaagcgcttcaggcaatcgagcccgcgttgcatggattcttcgttgagttgacggtcttcgtcgatcccggcggccaactgcaccttttcaccgagccgctcgagaatgcggatttcattatggtgagccttggccacgaccatgtgaaagctgttggagcccaggtcgatggcggcgatcagggacagattcttggcttgggtttgcggcatggtttgggggtctcggtcgataaccttgccatcctgccacgatcaatcgctcgcgccaacgcgcagcagtggccgaaggcgcgatccttgatgcaaggcaggcaaaagcgccgaaccctgcgggttcgatcgcgagcgagctcgctcctacaggggaatgcgggccactgtaggagcgagctcgctcgcgaaataatctggcaggcgccgcagagtctcagcccgccgcctcattggtcccgatgaaactcgccagttccggcgtctgcgggttggcgaacagcactttcgggtcgcccacttcatgcaccttgccctggtgcatgaacaccagcttgtcgcccacttcccgggcgaaacgcatctcgtgggtcaccatgatcagggtcatgccgtccttggccagctgacgcaccacgctcaggacttcgttgaccagttccgggtccagggccgaggtgatctcgtcgcacagcagcaccttgggcgacatggccagcgcccgggcaatcgccacccgctgttgctggccgccggacaggcggtcggggaaggcgtcgaacttctcctccaggccgacccgcttcagcatcttgcgcgccagctcggcggccctggccttgggcaccttctgcaccacctgcggggcgagcatgacgttctcgccgacggtcaggtgcgggaacaggttgaactgctggaacaccatgccgaccttctgccgcaggctgcgcaggtcggcgcgggcggcgtcgaggtactcgccgtcgacttcgatgaccccgtcgttgatcgactccaggccgttgagggtgcgcagcaaggtgctcttgcccgagccgctgcgcccgatgatcgccaccacctggccttcctcgatactgaggtcgatgcccttgagcacatgatggtcgccgtaatatttatgcagggcggaaattctaagcagaggcatgcagtctcctttccaggtagcgcgcactgagggacagggggtagcacagcaggaagtaaccgagcgccaccaggccgtagaccatgaagggctcgaaggtggcattggcgagcatgccgccggtcttggtcagctcggtgaagccgatgatcgaggtcaccgcggtgcctttgactacctgcaccgagaagcccacggtaggcgccacggcaatccgcagcgcctgcggcaggatcacatggcgcagttgttcataaggggtgagcgccaggctggaggaggcttcccactggccgttggggatcgagtcgacacagccgcgccagatctccgccaggtaggcgctggtgaacagcgtcagggcgatggccgccgccagccagggcgagatatccacccccagcagggcgatgccgaagaacaccaggaacagctgcatcaacagcggcgtgccctggaacagctcgatgtacaggcgggcgaagccgctggggaaagccttcttggaaatgcgcagggtcatgatcagcaagccgatcagcccgccgccgacaaaggccaccagcgacagcagcagggtccattgcaggccggtcagcaggttgcgcacgatgtcccagaagctgaaatcactcattgactgctcctcgcgatatagcggcgcccgacccagttcagcagctgccggatcagcagggccatgcacaggtaaatcagcgtggtcagggcgtaggtttcaaaggcgcggaagttgcgcgactgaatgaagttggcggcgaagctcagctcctcggtggcgatctgcgaacacaccgccgaaccgagcatgacgatgatgatctggctgctcagggccggccacaccttgcccagcgccggcagcaataccacatggcggaaggcctccaggcgggtcatggccagggccgccgcggcctccagctggccacgggggatggcctggatgccggcgcggatgatttccgtggagtaggcgcccaggttgatcaccatcgccagcaccgccgcctgccactcggagatctgcagccccagggacggcaggccgaagaagatgaagaacagctgcaccaggaacggggtgttgcggatcagctcgacgtagacgccgaagagggccgagaagggctggatcttccaggcccgcaccaccgcgccgactatgcccaggccgaccccgagcaatgcgccgatggcggtcagctcaagggtgaacagggcgccgcgcagcagcaggctggtgttttccagcaccggtagaaagtcgaactgataagccatggataacctccgcgacggcgatcagaggccagccggcaatggctgcttgagccacagctgggcgttcttttccaggctgccgtcggccttggcggtggtgaggatctggttgaccttgtccagcagctccggctggttcttgttcacgccgacgtagaccggggaatccttgagctcgaccttcatcgccgggatgcgtttcgggttgcgctcgctgatggcgaccattaccacgttgccgctggcgatcaggtcgacctggccggccaggtaggcggcgatggtcgagttgttgtcctcgaagcgcttgatggtcacgccttgcggggccacggcggtcagttcgatgtcttcgatggcgccacgggtgacgctgatggtcttgcccttgaggtcgtcgagggtggcaataggcgcttcgggtgggccgaatacagccaggtagaagggcgcgtaggcctgggagaaatcgatgaccttctcacgctccgggttcttgccgaggctggagatcaccaggtcgaccttgccggtggtcaggaacggaatgcggttggtgctgttgaccggggtcagttcgagtttgaccttgagctggtcggccagcagtttcgcggtgtcgatatccaggccacggggtttcatgtccggaccgaccgagccaaagggtgggaagtcctggggtacggccaccttgagggtgccacgggcgacgacatcgtccaggccgttggcgtgggcgggcgtctggctcagcatcagactggcaaacagggcagagagcagggcgctgaaacgcttggtcatggcaaatctccggattcacgggaagtgatttctgcgcagcgacacagcacagcccgtgccaaacgccggaaaaagccttggagcgccgggttttgctggcgtcgttcggtcttactggtctgaacagttgatggcgtttctgcccccttatcgagcgttcggccacccgcccgaacccccttggggcacgacttgccgggctcggcgaatagctttacaactagccttttcctggaccggccagcctgcattctatgaactcgatctcccgcgccgtacccgaggtggcgctgcaagccatccgccaattgatcaacgagcgcggcttcggcccgggcgatgcgctgccgtcgcagcgcgatctggccgtacagctgggggtcagccgggcttcattgcgcgaggcgctgtcatccttgagcgccttgggcgtgatcagcgtgcagcctggcaaaggcgtgttcgtgcaggccgcggaattgccggtcaatggcgcggggctgagctggccgttcgcggcccaggcatcgccaacggacatctttcaactgcgttacgccctggaaggcttcgccgcggggctggcggccgtgaccctgaccgccgacgagctggatgcgctgcaggataatgtcgaggccatgcgcaacgagctgcgggcggcggatttcgaggcggcggcgcggctggatttcgagtttcaccagaagatcctgcaagccagcggcaatcaggcaatggtgagcattctcagtaccagcgccgagatcttcctggagagccagaagctaccgttcatccggcccgagcgggccatggaaacctggcaggagcaccgcaagatcctccgcgggctggcccggcatgcctctggggcggcgcagaaggccatgcaggagcatgtgcgtggcgcggcgttgcgcaccggaatcgcctttgttacccccgcatagtttccagttgagctatacccaaactcatcgggcaccatagcgagagtcaatcaactccggcttcctgaacgcgggaagggcggctatgatgggccacgtttttttgcttacaacctggagacttccatgagcagcgatcttatcaaacacgttagcgacgctagcttcgaggctgacgtactcaaggccgaaggcgctgtactggtcgactactgggctgagtggtgcggcccatgcaaaatgatcgctccggtcctggacgaaatcgctgaaacctacaaaggcaagctgaccgttgccaagctgaacatcgacgaaaaccaggaaaccccggccaagcatggcgtgcgcggtatcccgacgctgatgctgttcaagaacggcaacgtcgaagccaccaaggtcggcgcactgtccaagtcgcaactggctgctttcctcgacgccaacatctaagcgtcgttgtaaatcgcatcaaaaaagccccgtaaatagcggggctttttcattattcagggctagacgctcagaaactcaggtgttacattcggccccgcactggtttctcctctgccccctgcaagccgtcgccgacgctctccttttcgaataagtacgcgatcctgtcgccttctccgcggcgcggcatcattaagccaaaagcttaatttcccccctccataaatgattacgtcattcctatatgaatctgactgaactcaagcaaaagccgattaccgaactgctcgaattggccgaacagatgggcatagaaaatatggcccgttcgcgcaagcaggacgtgattttctccctgctgaaaaagcacgctaaaagcggcgaggaaatctccggtgatggcgtgctggagatcctccaggacggcttcggctttcttcgctcctccgacgcctcctatctggccggcccagacgatatctacgtctccccgagccagatccgtcgtttcaacttgcgcaccggtgacaccatcgttggcaagatccgccctccaaaggaaggcgagcgttacttcgcactgctgaaggtcgacacgatcaactacgatcgtcccgagaacgcgaagaacaagatcctgttcgaaaacctgacgccgctgttcccgaccgtgcgcatgaagatggaagccggtaacggctccaccgaagacctgaccggtcgtgtcatcgacctgtgcgccccgatcggtaaaggccagcgcggcctgatcgttgctccgccgaaagcgggcaagaccatcatgctgcagaacatcgcgtcgaacatcacccgtaacaaccctgaagttcatctgatcgtgctgctgatcgacgaacgtccggaagaagtgaccgagatgcagcgcaccgtgcgcggcgaagtggtcgcctccaccttcgacgaaccgccaacccgccacgtgcaggttgccgaaatggtgatcgagaaggccaagcgcctggtcgaacacaagaaggacgtggtgatcctgctcgactccatcactcgtctggcccgtgcctacaacaccgtgatcccgagctccggcaaggtgctgaccggtggtgtcgatgcccacgccctggaaaagccgaagcgtttcttcggtgctgcgcggaacatcgaagaaggcggctcgctgaccatcatcgccaccgcgctggtcgagaccggttcgaagatggacgaagtgatctacgaagagttcaagggtaccggcaacatggaactgcccctggaccgcaagatcgccgagaagcgcgtattcccggccatcaacatcaaccgttccggcacccgccgcgaagagttgctgaccgccgacgacgagctgcagcgcatgtggatcctgcgcaagctgctgcatccgatggatgaagtcgccgccatcgagttcctggtcgacaagctgaaacagaccaagaccaacgatgagttcttcctgtcgatgaaacgcaagtaagtcgagcgggaccgcaaaagccggggaaacccggctttttgctatctgattattgatgaacggcagttcactgttctgaacagtcgggttcggcgctaaactgccagccccgaacgccacggccaaaacgaggctcacgcatgcagtatcgcgacttgcgcgactttatcagcggtctggaacagcgcggcgaactcaagcgcatccaggttccggtgtccccagtgctggaaatgaccgaggtctgcgatcgcaccttgcgtgccaaaggcccggcgctgctgtttgaaaagcccaccggctacgacattccggtgctgggcaacctgttcggcaccccggagcgcgtggcgctgggcatgggcgccgaggcggtcagcgaactgcgggaaatcggcaagctgctggcgttcctcaaggagcccgagccgccgaaggggctgaaggatgcctggtcgaagctgccgatctttcgcaagatcatttccatggcgccaaaagtcgtcaaggacgcgatctgccaggaagtggtcatcgaaggcgatgacgtcgatctggcgatgcttccggtgcagacctgctggccgggcgatgtcggtccgctgatcacctggggcctgaccgtcaccaaggggccgaacaaggaccggcagaacctcggtatctatcgccagcagatgatcggccgcaacaaagtgatcatgcgctggctgagccaccgtggcggcgcgctggattaccgcgaatggtgcgagaagcatccgggccagccgttcccggtgtccgtggccctgggcgccgatccggcgaccattctcggcgccgtgacgccggtgccggacagcctctccgaatacgccttcgccggcctgctgcggggcaaccgcaccgaactggtgaaatgtcgcggcaacgacctgcaagtgccggccactgcggaaatcatcctggaaggggtgatccatccgggcgagatggccgatgaaggtccgtatggcgaccacactggctactacaacgaagtcgacagcttcccggtgttcaccgtcgagcgcatcacccaccggatcaagccgatctaccacagtacctacaccggtcgtccgccggatgagccggcgattctcggcgtggcgctgaacgaagtgttcgtgcctatcctgcaaaagcagttcccggaaatcaccgacttctacctgccgcccgaaggctgctcgtaccgcatggcggtggtgaccatgaagaagcagtaccccggccacgccaagcgggtaatgctcggtgtctggtcgtttttgcgacagttcatgtacaccaagttcgttattgtcactgacgacgatatcaacgcgcgcgactggaacgacgtgatctgggccattaccacgcgcatggaccccaagcgcgatacggtaatgatcgataacacgccgatcgactacctcgacttcgcctcgccggtctccggcctgggctcgaagatggggctcgatgccacgcataaatggcccggtgaaaccacccgcgagtggggccgggtgatcgtcaaggatgaggcggtgactcgccggatcgatgccatctggaatcagttaggaatagattgatgcgtgtaaccttgcagccctccggagcggtgcttgagacgctgcccggcgagcggattctcgatgcggcgtggcgcctgggctatgaatgcccgcaaagctgccgcaatggcaactgtcatgtgtgctgcgccctgctggtggagggccgcgtcctgcaggccggcgatgtgcgcgatcatggcgagttctacacttgcattgcagagccgctgcaagactgcatcgtgctgtgggatggcgtccttgcgctgggagaactgccggtgcgcagtctgtcgtgtcaggtcaccgagtgtctggaagtcggcggtgatgtctggcgggtccgcctgcgggcgcccgccggcaagccaccgcgttatcacgctggccagtacttgatgctcgagcgggagaatggcgagaagtcggcattctccctggcctcggcgccacacgccgggcgcgacctggagctgcacgtactggtgcgcgaaagcagtgcacaaagcctgatcgaacagttgcagcgcaacggcaacgtgcgcgtcgagctgccgtttggcgatacccacctggccgagctgccggacgggccgctggtgctgatcgccgccggcaccggcatggcgcagatgcacagcctgatcgagcattgccgggccaagggcttcaaatacccggtgcacctgtactggggcgtgcgccggccggacgacttctaccagatcgaacactgggacgaatggaaaaagctgcccaacctgttcttgcacaaggtggtcagcgacctctgtggctgggaagggcgctgcggcatgctgcacgaggcggtgagcgaggatatagccgacctgtcggcggtgcatgtctacgccagcggctcgcctgcgatgatctacgcgaccctcgacgcgctggtcgaagcgggcatggatgcgcaccagatgcgcgccgatgtatttgcctacgctcctcggtcctgagttctcggggctgtccctcgttataacttcctatatagctcatcggtatttatttaattagataaatgccggtaggttatatgtcacgcattattgaaagttaaaactcttcgatggcacttaacttgccttgaaacatatgtgtcttggagttacagccgtgcgttctattaagtaattctttatacgcggggagccaaacgctattcgccatgacagccattgaatccagttttttgaatctggcttaccctccgcggctcgacctggggccgcagctcacccacgaacagcttctcagctcgatgcaatccaccatggcgcgccacaagggcgggccggtctggctgtttgcctacggttcgctgatctggcgccccgaatgttcggcggtcgagcgcatgcgcgggcgggtgcatggctaccatcgcggtctgtatctgtggtcccacgagcaccgtggcacgccggagaagccggggctggtctttggcctggatcgtggcggttcctgcagcggcttcgcctaccgcctgccgcaagagcagctggaaacctcgctgtatgcgctgtggcagcgcgagatgccatacccgtcctatcgcccgcactggctcaactgccgtctcgaagacggtagccgggttcaggccctggggttcgttctggagcgacacctgcccagctatgccggcaacctgccggaccatgtgctgagtcaggtatttgaaaacgcctgcgggcgctacggcactactcgcgattatgtcgagcagaccgtgcacgccctgcgtagccacgccatgccagaccgtaatctggaggcgcggctcaagcgctgtaagtcagccacccattaggcaatggcttcgcgactctggctggcgacctgtttgtgccacagggtcggggccaggaaggccatcgacagcaggcaggcgccgaccagcaggacaaaaccgccgtcccagccgaagtggtccacggtgtagcccatcgccgcgctggccgcgaccgaaccacccaaatagccgaacagaccggtgaagcccgcggcggtgccggcggctttcttcggcgccagttccagggcctgcaggccaatcagcatcaccgggccatagatcaggaagccgatggagaacagcgcgatcatgtcgatggtcgggttgccggccgggttcagccagtacaccagggtcgccacggtcaccagggccatgaacaccatgccggtcaggccacggttgccgcggaagatcttgtccgacatccagccgcacagcagcgtgcccgggatccccgcccactcgtagaagaagtacgcccacgaggttttatccacggtgaagtgcttggcttccttgaggtaggtcggcgcccagtcgagtacgccgtagcgcagcaggtagacgaagacgttggccatggcgatgtaccagagcattttgttgcgcagcacgtatttgacgaagatttccttggcgctgaattcttcttcgtggctggcgtcgtagccttccgggtagtcgttcttgtacttctcgattggcggcaggccgaccgattgcggggtgtcgcgcatggtgacgaaggcgaacagcgccaccatcagggccacggcggccgggacgtagaacgccgcgtgccagtcgttgaaccagaccatgccgagcaggaacagcgggccgatcaggcctccgccgacgttgtgcgccacgttccataccgaaaccacgccgccgcgttccttctgcgaccaccagtgcaccatggtccgtccgcttggcggccagcccatgccctgggcccagccgttgatgaacagcaggatgaacatcatggtcacgctggacgtggcccagggcgcgaaaccgaaaatgaacatcaccccggccgacaccagcaggccgaagggcaggaagtagcgcgggttggagcggtcggacaccaggcccatgaggaacttggacaggccgtaggcgatggcgatcgccgacatggccaggcccagctgaccgcgggtgtaaccctcttcgatcaggtacggcatggccagggagaagttcttgcgcagcaggtagtagccggcgtaaccgatgaagatcccggcgaagatctgccagcgcaggcggcggtaggtactgtctattttttcgtcaggcaggggcgcctgatgtgcggcaggtcgaaagaaagcaaacattcaagagctccaaatttcttgttttgactgcggatgcgaatgttacagtttcgttaccgaaaatagcactgcatcttatctgggggcacgcaacgcaggagcatttgcatgttcttttacgaacatgtcgcttaaagataagtgggggacgtacctgatgcttctgtgtaggagcgagcttgctcgcgatggcgatccgacagtcagcaatgaagtcgactgtcacaccgctatcgcgagcaagctcgctcctacataaagaaaagggggaggttcagcgaacctggaccaccaccttgcccaccgccttgcgctggccaagatcgttgatggcgctggcggcgttgctcagtgggtagacctgcgagaccagcggcttcaacttgccttcggcgaaccagccgaacagctgctggaagttcgccgcgttgtcctggggctggcgctgggcgaacgaaccccagaacacgccgatcaccgcggcgcccttgagcagcgccaggttgaccggcagttcgggaatgcgcccgctggcgaaacccaccaccagcagccggccgttccaggcgatggcgcggatggcctggtcgaacaggtcgccgccgaccgggtcgtagatcacatcggcgccctggccgtcggtcaggcgcttgatctcgtctttcaggctggtttcgctgtagttgatcaattcgtcggcgccggcggccttggccaccgcaagtttctcggcgttgctggcggcggcgatgacccgggcgcccatggccttgccgatttccaccgccgccaggccgacaccgccggaagccccgagcaccagcagggtttcacctggctgcaggttgccgcgttgcttgagggcatgcatcgaggtgccgtaggtcatgctgaaggcggcggcggtgttgaagtccatcgacgctggaatcggcagcacgttgtagcccggtaccgccacttcctcggtaaagctgccccagccggtcagcgccatgacccggtcgccgaccttgaggtggctgaccttctcgccgaccgcgccgaccacccccgcggcctcgccaccgggcgagaacggaaagggcggcttgaactggtatttgccctcgatgatcagcgtgtccgggaagttcaccccggccgcgtgcacctgcagcaggatctcgttcttcttcggcacaggactcgcgacgtcttccagcaccagcgtttcggcggggccgaaggctttgcacagcacggctttcatcagggctattcctttgggagtgatggccgataagtgtaggtgggtgaataacgcggtcaacgagcatgccccggcctgatagccagccataagctttgtgcttgggcacgggcgcaggggcctttatgctagaccgcctaccggataaggagcgaactgtgaaagcgtggatcatgttgatgctggccctgtctctgccaatggcagccatggccgaggaagccaaagagggcgaagcaccgaaagtcagttacatcagcctgaacccgccgttcgtgggcaactacggtctggatggtggcccgaagctcaaggtctacaaggccgacgtcgccctgcgggtgaccggcgatgccgccgcccaggcggtgaaggccaacgaaccgttgatccgcaaccagctggtggcactgttcgcccagcagactacggaaaccatgaacaacgtcgaagccaaggaaaaactgcgccaggaagccctgaagcagacccagcaggtgatgaacgacgaaactggcaagccggtggtggaagacctgctgttcaacaacctgatcatccagtaatgctggatctgtaggagcgagcttgctcgcgatagcgatattgcaagctccgccgcatttcagcctggcggctgatcgcgagcaagctcgctcctgcaagttggcaccctgaggcaacctcaggacgccaggctcttgcggaaccgcgccaaggcgatgccgaagaacagcaggccgatcaccgccagggccagcaggtctggccagaccacctcgatgccggcgccgcgaaacagaattgcggcgctgaggctgacgaagtgggtcgacggcgagccctgcatcacccattgcagccactggggcatgctgtccagcggggtactgccgcccgacagcagcaacatcgggatgatcaccggaatcgccagcaggccgaattgcggggtcgagcgcgccagcgtggcgagaaagatccccagcgcggtgctggcgaacaggtaaagcccggtcaccgcgaggaacagcgccagcgatccggccagcggcacgcccagcacgcctttgacgatcacctccagcgacatccaggtgcagagcaccaccaccagcatgttgctccagatcttcgccagcatgatttccagggcggtcagcggcagcaccagcagatggtcgagggtgccgtgctcgcgttcgcgcagcagcgccgtgccggtcaggacaatggccaggatggtgatgttgttgacgatctggatcaccgcgagaaaccagccgccctgcagattggtgttgaacagcgcgcgactggtcaacagtgccggcatccggctcgccgggtcggcctggctgtagttgaggagttcgcgctggaaaatccgcccgatataaccggcgcccatgaaggcctggctcatggccgtggcgtcgacattcacttgcacgctgggttggcgcccggccagcagatcgctctggaagttggccggcacattgatgacgaaggtgaactggccgctgtccaggacctggtccaactggtcgtagggcaactgcaccgggctctggaattccggtggttgcagggcctcggccagctggcgcgagagctggctgtggtcttcgtccaccagcgccacgctggcgttgtgcacgccgatcaccgaaccggccgccggcatgtagatggccacggtgaaggcgtacagcagaaacagcagcaacacgctgtcgtgtcgcaggctggtgagctccttgaggcccaggcgcaggatatggctgaaccggtgcatcaggcctcctgttttttcagcatcgccaggctcagcccggtgaacccgaggaagaacccgaacagcgccaggcactgcggccacagctggcgcaggtccagggccttggtgaaggtgccgacggcaatgtcgaggaagtaaccggcggggaacagctgccccatcagcgccgcggcgccgtccagcgacgagcgcggcacgatcagcccggagaactggatggtcggcaggctggtgatgatcatggtgccgaggatcgccgcgatctgggtacgggtgaacgcggaaatcagcaggcccaggctggtggtggccagcacgtacagcaggccgccgaaggccagggtcaggccgctgcccttgaagggcacgccgaacagccagcggttcatcgccaccagcagcgccaggttgatcaggctcaggcccaggtagggcgcctgtttgcccaggagaaactccaggcgcttgagtggcgtggcgtagaagttggtgatcgagcccagttccttctcgcgcacgatgcccagcgccgtgagcatcgccgggatgaacgccaggatcagcgccatcaccccggggccgatggcgttcacgctgaccacgtcctggttgtagcgaaagcgtgtttccagccgggccgcgggtgctcgccccagggccgggctgctgtgttcggcgagcaattccatattggcctgatgcaccgcctcgacatagttgcggctggtctcggcgcgaaacggcatgccgccgtcgagccaggcggccaccgcgggctggcgcccggcgtacaggtcgcgaccgaaaccggggggaatctccagggccagcttgatctccgagcgttgcaggcgccgatgcagttcggcggcatcgcggatcggctgctgctccttgaagtagcgggagctgcggaaggcttccaggtaagcgcggctttgcggggtctggtcctggtcgtagacggcgaaggcgaggttttccacgtccagggaaatgccgtagccaaagatcaccatcatgaacagcgccccgagcagggcgaagcccaggcgcacccggtcgcgcaacagctccttgccttcgcgggtggccacggcgatcaggcgcgacaggcgcaagcgccgactgtcactgtgaatggcgctgctgacctcgggctgggcggtcgccggcggaggtgcttgcggcgcgccctgggcgtcttccaggcagcggacaaaagcggcttccagggttttgccggcgaactgttgctgcagggcggccggtgtatcgcaggccagtaccttgccggcgtgcatcagcgagatgcggtcgcagcgctgggcttcgttcataaagtgggtggacaggaagatcgtcaccccctgttcccgcgacagctcgatcaacagccgccagaagtcgtcgcgggccgccgggtccacacccgaggtcggctcgtcgaggatcagcacttccgggcggtgcagcaccgccaccgccagggacaggcgttgacgcaagcccaggggcagggcgccggagggttggtcggcgatctcctggagagcgaagcggcggatcagctcttcgatccgcgggccgctctcggccttgggcaggtcgaacagccgggcgtgcagcaccaggttctggcgcacgctgagttcgccgtacagcgaaaagctctgggacatgaaacccacgcgcttgcgggtggccaggtccctggcgtccaccgggttgcccagcagtttggcgctgccctcggtggccggcatcagcccggtcaggaccttcatggtggtggtcttgccgcagccgttggagccgagaaagccgaaaatctcaccccggccaatggcgaagctgaccttgttcacggcggtgaaatcgccgaaacgcagggtcagctcatgggcttcgatagcaacttgctggttgtctgtggttcttggtgggatcaccagcggctggttgtcgtgcccactgtcgccttgaaagtgggtgaaggcatcgtcgagcttgccgctgggcgtggcgatggccagttcccggctcaagccctgggcaatcagccggccgcggtcgagcatcaggcagtgctcgaactgctcggcttcctccatataggcggtggccaccagcagcgtcagttgcgggcgctggcggcgaacctcgtccaccagttcccagaagcgccggcgggacagcggatcgacgccagtggtgggttcgtcgaggatcagcaggtcgggctcatggatcaatgcgcagcacagcccgagcttctgcttcatcccgccggacagcttgcccgcgggccgttcggcgaaacgcagaaggtcggtggccagcaacaggttgtgcatgcgctgttcgcattcggttttcgacaggccaaacagggtggcgaagaagcggatgttttcctcgatcgacagctcgggatacaggttgccgcccaggccctggggcatgaaagcgatccgcgcgtacaggctgttgcgatggcggcgttgttcgatggagccgccgagcacctgcagttggccctgctgcagcttcttcaccccggcgatcaagcccagcaggctcgacttgccggcgccatccgggccgatcagcccgcagcgggtgccgccgggcaggctgaaggcgaggtcgaccagagcctgttgcgagccataacggtggttgatgcccgtggcctgcagcgccagttcgttcattgcaggttggccggccaggccacggtcgcggtgcgcacgtagccggcgccgggcatgcccggcttggcctgcggtacggcgctgggttcggtcagccgcagcttgacgcggaacaccagtttttggcgctcatcgcgggtttccacttccttgggggtgaattgggacttggctgcgacgaagctgatcttcgccggcagcggctgatcgggcagggcgtcgagcaggatccgcgcctcgctgccgacagccaggcggccggtcaccgaggcggacaggtagaggttcatgtactggtcgctcgggtcgatcagcagcaacacccggccgccggcgcccaacacctcgcctggttcggccaggcgcagctggatgatgccgtcgatgggcgcgcgcaggctgctgtcgtcgatctcgctggtcagctgggcgaccatggccttggccgagccaatggcggcgcgcatcgcggcgacctgggcctgggctgcttggacggcggcgttgccggtgttcaggcgcgcctgctgctggtcgatgatctgctggctggcgtaaccacggttgaacagttcccgggaacgcttgagttcctggttggccagcagcagttcgctctggcgcagatgcacattggcttcggccgccgcgaggttttcccgggtgcgcaccacgtcggcctcggcctgggcgcgctgggcctccagggtgcgggtgtccatgcgggccagcaattggcccttggacactttgtcgccttcgtcgacgagcacttcggccaggcgtccaggcgtcttgctggcgatctgcacttcggtggcttcaagccggccgttgcccatgctcaggccttcgggcaggcggtccagggtggacttccagtaaccaaagccgcccgcgatcagcagcaatgccaacaaggcgaaggcaaaaaggcgggaggagcggtgattcgtcggcattggggggcatccctgcggctatagcgtcctgggctctgtacgaaaagtggctgcgcgctgggcgccttcggcgctacgcaggccatgctgcgttaaaaacaggctcggaatgctcatgtaggtccctacagtcgaacgcgaccccggccgttcctcgcctgtttttgccttgcctgaccttcgctcgccgacttttcgtacaggccccagtctggcggctcaagccgttgggcgacttgatgtccgtcaaatgaacgggcaagcctagtacgatgtgcgcgggatgcctgcctgagtatcgcttgcggcctgttcagcgcagcgtgagcaccgccgcccactgttcggcggtcactggcatcacggacagccggctgcctttctgcaccagaggcagctcggcgagggcggtttgctgcttcagataatccaggcgcagcaccttggggaaggtttcgacatgggcgacgtcgacggcgctccaggcgtttttctcggcgctggccttgggatcgaaatgcgggttttccggttccagggcggtcgggtcggggtaggcggcctcgatgatccggccgatcccggcgatgcccggttcgggacagctggagtgataaaagaagaattggtcacccaccgccatgctgcgcaggaagtttcgtgcctggtagttgcgtacgccgtcccagcgcgcctgtttcttgagtgccaggccctcgatcgagagttcttccggttcggatttcatcagccaataggccattttctgtgctctccagagggacgtgggcaagttgtcgggcaattttatgacaaaccgacagtcggttgacgtcagcatttgcgtgtcggttcacgttatcgcagaatgccgggattttaagcttgacgctgctgcacggcctgttatggaaaccgtcgctgtcatcgtgtgggatttgcctgaggggggcaatcgatgcaacgcaaaccggatttactatggattttggttattttgttcggtttgggcgtagtgacaaccggttatgcgcagagcctgtgggccaacaagaccgacgcaccggtcgagctcgcgcaacagcagcagccttacaaacgttgattccttccaaggcgccgctctctcctggtggcgcctatttcgcgaaataccatttcttgtcagtcaccgttccttgcagcggtacatcccagctcgcctgatccagtttcgcgactttctgacattcgtgggccagccccagtagcgtcggcttgcgccagcttttgcgccgcgccagataggccaggctgcgatcatagaaaccaccgcccattcccaggcgtccacccgcctcatcgaagccgaccagcggcaacagcaccagatccagggcccagaccttgcgttgccgggccaggctcacccgtggctcgggaatgcggaagcggttggggcgcagtttctccccggggcgaacccgctgaaacaccatcttggtccgtggccaggcgctgagcaccggcagataagtcgccttgccccggcgttgtgcggcaagcagcagcgggcgcgggtcgatttcaccgtccatgggcaggtaaagggagatgtgcctggcgcggcggaacagcggatgctgcgccagttgccgatacagcccacgagaggcctggcgttgttcgctggcggtgagggcgcggcgggctttacgcaggatgcgtcgaagttgcgggcgggaaagcggcgccggttcggtcatggtcgctcgggtccgggaggggtacggcaggacagcgtaccaaataacccctgatcgaaaaaaaacggagccgaaaaaaacggaactgaaaaagcggagcccaaaaaaaacaatgccagctatttgcatagctggcattggtctggaattcaggctccccggatgaaccgctgtcgacttagcccttgaacccgaaagttcaaggcggaagatgcagtaggcgttaaggctttccgtctagcggacatgcacaccggcccaacgtgcaacttccagggtagtgcgaatcggctcagggacatcgccaactggcaagcaccccagggagtggtggggattataccgcaaccaccctcaggaatcagccttggttgtatcggtgtcggtggcgagcaccagatccacgcgctcgagcaggtcgcgcacctgttcgcgggtcgaaccgctggcttgcacgtcagggcggtcctgcttgtgcagcagatcgtgggtgatattaagggcggccatcaccgcgatacgatcggcgccaatgactttgccgctgctgcggatctcgcgcatcttgccatccaggtaccgggcggcgctcaccagattgctacgttcttcctgggggcagatgatcgaatactctttgtcgaggatctgcacagtaacgctattgcttgaactcatgagtcttgctccagggccttgaggcgcgaaatcatcgattcgaccttacgccgggcgatttcgtttttttcaatgaggtgcgcgcgttcctcgcgccaagtcttttcctgagctaataagagtgcgttttgactctttagttgctcgacccggccaattagcagttcgagtctagccatcagcgcttgcagatcggtgtcttccattggatcccactggatttgtctgatgagtggcaactgcctgggcaaacgagttgacggcctcgatggtcttggcgcgtctgccgatgctaggatacaaggcctccattctagacattgcgccgcttggcgcctagctacccatgcccattcagaattccccgtacaacgccttcgccaccctgctcagcagcagcggtcaccctgtctcgcccgccgaattgcatggcctgttgctgggtcgcagctgcgccggcgccggcttcgaagtcgacggctggctgatcgacgccgccgagctgctcgaaggcgagccgcaggacaatgttcgcaacgccttgatcggcctgcaggaaatggtcaagggcgagctgaccagcgacgacatgaccgtcgtcctgttgctgcctaccgacgatgccccgctggccgagcgcgctgcggccctgggtcagtggtgccagggtttcctcaccggcttcggcctgaactcccgcgacagcagtgccctgagcaccgaggccacggaagtgctgcaggacctggcggcgatcgcccaggtacaggacgcgctggaagagtccgacgacggcgaaagtgactacatggaagtgatggaatacctgcgggtcgccccgctgctgctgttcaccgagaccaacaagacggttgaaccggccgccaagccttctctgcactgatcgctcgatagggaaatccgtctgcccatgatccatatcccgaaatcggaatacacccgccgccgcaaggcgctcatggcgcagatggaacccaacagcatcgcgatcctgccggctgccgcggtggcgatccgcaaccgcgacgtcgagcatgtctatcgccaggacagcgatttccagtacctcagcggcttccccgaaccccaggcggtgatcgtgctgatgcccggtcgcgagcatggcgagtacatcctgttctgccgtgagcgtaatgccgagcgcgaactctgggacggcctgcgggctggccaggagggcgcgatccgcgattacggcgccgacgatgccttccccattaccgacatcgacgacatcctgccgggcctgatcgaaggccgtgaccgggtgtattcggccatgggcagcaaccccgagttcgatcgccacctgatggaatggatcaacgtgatccgttccaaggcgcacctgggcgcccagccgccgaacgaattcgttgccctggatcatctgctgcacgacatgcgcctgtataaatcggcggcggaagtgaaggtgatgcgcgaggctgcgcggatttccgcccaggcccatatccgggccatgcaggccagccgcgccggcctgtacgagttcagcctggaagccgagctggactacgagtttcgccggggcggggcgaagatgccggcctacggctcgatcgtcgccgccgggcgcaacagctgcatcctgcattaccagcagaacgacgcgttgctcaaggacggcgatctggtgctgatcgacgccggttgcgaaatcgactgctatgccagcgacatcacccgcacctggccggtgagcggcaagttttccgccgagcagaaggcgatctacgagctggtgctggccgcccaggaagccgcctttgccgagatcgcgccgaacaagcactggaaccaggcccatgaagcgaccgtcagggtgatcaccaccgggctggtcaagctggggctgctcgaaggcgaggcggacgagttgatcgccagcgaagcctacaaggcgttttacatgcaccgcgccggccactggctgggcatggatgtacatgatgtcggcgagtacaaggtcggcggcgaatggcgggtgctggaagtcggcatggccctgacggtcgagccgggcatctacatcgcgccggacaatcagaacgtggcgaagaaatggcgcggcattggcgtgcgcatcgaggatgacgtggtggtaaccaagcaaggctgtgaaattctcaccgatggcgtgcccaagaccgtggccgagatcgaggccctgatggccgccgcccggagccacgcagcatgaatcgggtcaatctggcgatcatcggcggtggcctggtcggtgccagcctggccctggccttgcaggccggcgccaaggagcgtggctggaagatcgtgctgatcgagccgttcgctccgggcgatacctatcagcccagctacgatgcgcgttcctcagcgctgtcgttcggcgcgcggcagatctatcaacggctgggtgtgtggcaggaaatctcccgccgcgccgagccgatcaaacagatccatgtctccgaccgtgggcggttttccaccgcgcggctgtcggccatggaggagggcgttcccgccctgggttatgtggtggaaaacgcctggctcggccaatgcctctggcaagggctggacaaggacgtggtgagctggcgctgcccggccgaagtcacgcgcatggagccgctggaagacggctaccgcctgaccctcaacgatgaaaccagcctggattgcgaactggcggtactggccgacggcggtcgctccgggctgcgcgagcaactggggatcggggtgaaaaagcgcccctacaaccagagcgcactgatcgccaatatcaccccgagcgaagcccataacggcatggccttcgagcgcttcaccgacgacggcccgatggccctgctgccgctgccggacaaccgctgcgcactggtctggacccgcctgggcatggacgcgcagcgcctggccgcgctggacgaacgcagcttcctcagcgaattgcagggggtattcggttatcgcctgggaaccctgaaacaggtcggcgcgcggcatctttacccgctggcgctggtggaggccgaggagcaggtgcgtcctcacctggtggtgctgggcaacgccgcccatagcctgcacccgattgccgggcagggtttcaacctgtcgttgcgcgacgcccaggcgctggccgatgccttgctggtcagcccgacgtcgccgggcgacttcagtatcttgcaggcctaccgcgagcggcagcgcctggaccaggacctgaccgtgggcttctccgaccaggtcaccaggctgtttggcagcaagctgccgctggtgtccctggggcgcaatatcgggctgctgggcctggacctgctgccaccggccaaacgctggttcgcgcggcaagccatgggcctgggtacccgtcccgatgcgtgagtggttgagcccgcgaccgggcatggaaatccagcacagtgtcggcagccaggtagcgcggttcgacaaaaccctttacgtgcggctcaagccgcaagcgagacaggcttaaagcatggaaatgcgtgcagatctgctgattgtcggggccggaatggtcgggagcgccctggcgctggcgttgcaggacagcggcctggaagtgctgctgctcgatggcagcccgctgaaggtcaagcccttcgacgacgaagcaccgttcgagccgcgggtgagcgcattgtcggtggccagccagcggattctcgagcgcttgggtgtctgggaaggggtgacccggcggcgcagcagcccgtatgccgagatgcaggtctgggatggcagcggcaccgggcagattcacttctcggccgccagcgtgcatgccgaggtgctgggccacatcgtggaaaatcgcgtggttcaggacgcgctgctggagcgtctgcacaactgcgacatcggcttgttggccaacgcccgcctggagcagatgcgccgttccggcgacgactggctgctgaccctggccgatggccgcagcctgcgcgccccgctggtaatcgccgccgacggcgccaattcggcggtgcggcgcctgaccggctgcgctacccgtgaatgggattacctgcaccacgccatcgtcaccagcgtgcgttgcgccgagccgcaccagaggaccgcctggcagcgtttcaccgacaacggcccgctggcgttcctgccgctggagcgcgacgggctgcacgattggtgttcgattgtctggtcgaccacgcccagcgaggccgaacgcctgatggcgctggacgacagcgacttctgccgtgagctggaacgcgccttcgaaggccgcctgggcgcggtgttgagcgccgatccgcggctctgcgtgccgttgcgccagcgccatgccaagcgttacgtggcgcaaggcctggccctgatcggcgacgcggcccataccatccatccgctggccgggcagggggtcaacctgggcttcctcgatgccgcggtgctggccgaggtgctgctgcaggcggccagccgtggcgaacgcctggccgacaccaaggtgctcagccgttacgagcggcggcgcatgccgcacaacctggcgttgatggcggcgatggaaggcttcgaacggctgttccaggccgatccgctgccgctgcgctggttgcgtaataccgggctgaaaatggtcgaccagatgcccgaggccaaggcgctgttcgtgcgccaggcgttgggcctcagcggagacctgccggaactggccaaggcctgaccgctatcgcgagtagtcgaaccgctcaaccggcggctcccgcaggggccgcgcggacatgtgtgggcgcgcgtctgctcttaacccatgctggcgatgcctcagcaacatctcgtaacgcctcgggctccggttcagtttgagaagctaaatagtagtccctatcatttagtccccctttgatttcgagagaccgctcccatgttggcaccgaagcgtctactgaccgccctggccctcaccctcattggcggcactgtccaggcagccgacgaagtggtggtctactcctcgcgtatcgacgagctgatcaagccggtcttcgatctctacacccagaaaaccggggtccaggtgaagttcatcaccgacaaggaagcgccgctgatgcagcggatcaaggccgagggcgagaacgccaccgccgacctgctgctcaccgtcgatgccggcaacctgtggcaagccgagcagatgggtatcctgcagccgttcgactccaaggtgatcaaggccaacatccccctgcaataccgcgccgcctcgcacgcctggaccggcctgagcctgcgggcgcggactatcgcctactccaccgcgcgggtgaaaccgtccgaactgaccacctacgaagccctggctgacaagcagtgggaaggccgcctgtgcctgcgcacggcgaagaaggtctacaaccagtcgctgaccgcgaccctgatcgaaacccatggcgcggcgaaaaccgaagaaatcgtcaagggctgggtcaacaacctgtccaccgacgtgttctccgacgacgtcgcggtgctcgaggcgatcagcgccggccagtgcgacgtgggcatcgtcaacacctactactacggccgcctgcacaagcagaagccggatctgccggtcaagctgttctggccgaaccagggcgaccgcggcgtgcacgtcaacctgtcgggcatcggcctgaccaagcacgcaccgcacccggaagccgccaaggccctggtggagtggatgaccaccgaggaagcgcagaagatcttcgccgacgtgaaccaggagttcccggccaacccgagcgtgccgccgtccgccgaagtggccgcctggggcaagttcgtggccgacaccctgccggtggaagtcgccggcaagcgccaggccgaggcgattcgcctgatggaccgtgctggctggaactgatccgctggttatactgcgccccgcttttgcggggcgttttgtttaaccggtttgtaattgccttttattgatccatctcgttcgagagtctttcgtggcccatcccgcccaacgtcgctggtacccgctgttttttgccgtcgccgccctggtgctgttgccgctgagcgtgctgctgctgtcgtggcaggtgatcgaccagcagatctggtcgcacctgtgggagacccagatgccgcgcctgctgggcaacaccctgaccctggtgctgggcgtcggcgtcggcgtgacgctgctgggcgtgagcctggcctggctgaccagcctctgcgagtttcccggaaggcgctggctggactgggcgctgatgctgccctttgcgattccggcctacgtgctggcctttgtcttcgtcggcctgctggatttttccggcccggtgcagaccctgctgcgcgaatggttcggcacgggcctgcgcctgccgcgagtgcgttccaccggcggggtgatcctggtcctggtgctggtgttctatccctatgtgtacctgctggcgcgcactgcgttcctggcccagggcaaaggcctgatggaagccgcgcgggtgcttggacagacgccctggcaggcgttctggcgcgtggccctgcccatggcgcggccggccatcggtgccggtgtggccctggcgctgatggaaaccctggcggacttcggcgcggtggcggtgttcaacttcgacaccttcaccaccgccatctacaagacctggtatggcttcttcagcctgtccagcgccgcgcagctggccagcctgttgctgctggcggtgatgctggtgctgtacggcgagcgtcgcgcccgcggcgccagtcgctcgggtaacgagcggccgcgaggcaaggcgctgtatcacctgcatggcatcaaggccctggcggccaccagctggtgcgcgctggtgttcgcctgcgcctttgtcatcccagtgctgcaactgctggtgtggttctggcagcgtggccgtttcgacctcgacgaacgttatgccggattgatcctgcacaccctgtacctgggcgccatggcggccctgatcacggtcagcgtggccctgctgctggcgttcgcccgacggctggcgccgacccgggcgattcgttccggcgtcagcctggccaatctgggatacgccttgccgggctcggtgctggccgtgtcgatcatgctggccttcagttatctggaccgcgaactggtgatcccgctgtcgggctggctgggtggggcgggcaagccgttgctgctgggcagcctggcggcgttgctgctggcctatctggtgcggtttatcgcggtggcctacgggccgctggaaagcagcctggcgcggatccgcccgtcgttgccggaggcggcgcgcagtctgggggtcagcggaccgcgactgtttttcaaagtgtatctgccgctgttgctgcccggcaccctgagcgcggcgctgctggtgttcgtcgatgtgctcaaggaaatgcccgccaccttgctgatgcgcccgttcggctgggacacgctggcggtgcggatcttcgagatgaccagcgagggcgagtgggcgcgtgccgcgttgccggccctgaccctggtcctggtgggattgctgccggtgatcgggctgatccgacgctccgctcatcgaatcggttaggtgccagtgtcacaccttgcggctacaatgcgcggcattcggtgtggtcgatctttctgatcgggtcttttgaattgtctgagagccatctatttcaaggtttccagctcatacagcgaccgcccgcaccttcgccacgcccggaaggagaaacccatgggacagcgcacgcctctgtatgaccttcatctcgccctgggcgcgaagatggtcgattttggcggttgggatatgcctctgcattacggctcgcaggtcgaggagcaccatcaggtgcgacgcgattgcggggttttcgatgtatcccacatgaccgtgatcgatgtcgacggcccccaggccaaggcctggctccagcacctgctggccaacgacgtcgaacgcctgcaaagcccgggcagggccttgtacagcgccatgctcaacgagcacggcggtatcgtcgacgacatgatcgtctaccgcaccgaagccggttaccggctggtggtcaacgccgccacccgtgaccaggatatagcctggatgcaggcgcaactgggcgctttccaggtgcaactgcacgaacgctccgagctggcgatgctggcgatccaggggccccacgcccgccacaagatcgccgagctggtgacccagtcgcgcggtacgctgatccagcaactcaagcccttcgaaggccaggccgatggcgactggttcatcgcgcgcaccggttacaccggtgaggatggcctggaaatcgtcctgccggccgaccaggccccggcgttcttcaacgatctggtaggcgccgggatctcgccgatcggcctcggcgcccgggacaccttgcgcctggaggccggcatgaacctgtacggccaggatattcaccaggaggtttcaccgctggtggccaacatggcctggagcatcgcctgggagccggcgtcgcgcaagttcatcgggcgcaccgccctggaggccgagcgcgcgggtggggtgaagcacaaactggtcggcctggtgctggaagaacgcggcgtgctgcgtgcccatcaggtggttcgcatcgccgatgttggcgaaggagagatcaccagtggtagtttctctcctacgcttagcaaatcgatcgccctggcgcgggtgcccatggctaccgccgaccgcgcagaagtggaaatccgtggcaagtggtacccggtccgggtggtaaaaccgaccttcgtgcgtcatggcaaaaccctgatctaacttatttccggcgggatctaccgctgacatttcttcttgaggacacagaacatgagcgatatccctgctgacctgcgttttgccgaaagtcacgaatgggcccgtctggaagccgatggcaccgtgactgtgggcatcagcgaccacgctcaggaagccctgggcgacgtggtgttcgtcgagctgaccgaagtcggcaatgtcttcggcgctggcgaccaggccggtgtggtggaatcggtgaaggccgcttccgacatctacgcgccagtggccggcgaagtgttcgcggtcaatgaagacctgagcggcagcccggagctgctcaacagcgacccgtacggcgcctggatcttcaagctcaagccggccaacgctgctgatcttgagaagctgctcgacgcagccggttataaggccgctatcggcgaataatccctgccagacgcgaatccgctacaagagcgccgtgttgcccttatcgggtacgcggcgtttttcgtttgcaggcgacacctgggggttggcctagcggcggagcgatctggcccgcagcacggctttgttcaccctgatgtgcagctctgccacttcttctgccgtcaaactcgtcgcgggctcgccgctaacccaggtgccctgattggtgtaggtgacggttttggtttctccgtcgttcacactcatgttgtaagggttggacaggctgctggggatcagcgaacccgccgcttgggccggaccgaaccatagttgaaactcgttttggggggtcatggtggcaatgcctatattcatgccgcctgagcggttcacccagagactaagtccggtggagtccaataatatattgctggggtgggccggaagttcgttatttattgaaacatctcctggcgttccagcattttttgccgggctgaatacaccatattgatccagagtggttatctggcctgtgttgatgggtaggttctttccgcctgaagtaaagttgacgtctccttcctgtagcggtgtgttggtgaaattcaccatgtaggaatcattggtgatattgaagatgttcttgtattgatacgtcggttggttgggggtggcgaatgggggttttgaaagccagatgacagtgaaggaactgtttactttcttggccaggtagaggctgtagttatttaccttttgtgcaacaagttgctcttcttcaatgtagataattatggtttgcttactcatggctaatctcacgctcatcctgtggatgatttaggtacagagtctcgactccacctggcccgttcgacgatgagttcgacgccatcaataaaaaaccctgtagatctacgatatacagggtttttcttgcatgagcgcaacgtgcgaacggaagactgccaatggcatcgcgcagtgctctaagtccttcgcgcaaccgatgctcgatccgcccggcggactatgccgcgatcccgagcctggcgtgcagcgccctgacttcagaggcgctcaggactctggccggttcgccggtcacccagacaccactgtcgttataggtgatggtgacgctgccgccatcctgcagggtcgctacataggggttggacaggttgatggcgatcaacgaaccggtttcctgaatgttgccgaaccagagttgatattggctctttggtgtcagcgtcgcagggccgatgttcatgccgctctgacggttcacccagatgttgttgccgttggaatccaggaggattgcatgcggattgccttgcagctcatttttgatgagaacatccgagggtacgccgccattcttggccggagtgaacacgccgttcgcatcgagcgtcgtggtctggccagtactgatgggcaggtttctgccgccggaggtgaaggtgacatcgccactgctgaccgggtcattggtgaagttgaccatgaaggacggggtagcgatatcaaaggtgtttctatattggtaactagggttgttgactgtggcaacagggccttttgattgccagatgaccgtaaagtcattgtttactttcttggccagatagaggctgtagttgttgttcttttgcgcaatcaactgttcttcttcgatgtatacaactatttgttggctgctcatttctttgaactccatttcgagtagattgaaacatggatttttgtaacggtctttgcaggtcgtaacttgcaactgcgtagtgattttttgcctcccttgcgcagtcacaagtaaacatagcaggcggaaagtggacctatagaatgattggctattgttttaaattcgtctgtatttcggagattttatgtatgggctcgtgctgatttatcatgtgcttatgtgtgcggttaaaatgagtcctgccaagagtctggtttttggcgcaaaggatcagacaagtggacatttatataactattggcaactgtatttattgctgaaataaaaaacgcccaatacgggatattgagcgtcttgaatattgcagaaaccagccgttcaagggctgggtatctatttatgtatcctgcaagacagccttcaccgtcgctaccgagcgttcgacatcgcccttgctcatggccgtgaacatcggtaacgagacgatcaggcgtcccacccgttccgccaccgggaacatcccttccttgaaaccgcgctcgcggtacaggctcagcaggtgaatcggcgggtagtgatagccgatgccgatcccacgttcctgcatctgctccatgaaggtcgcccgcgccggcttgccgtcatgccgctccggcagtaccagctggaacaggtgccagttgctgttgctgaagtccgccgggggcagctgggcgccgtagcgggcttcgaagtcgctgcccaagcattcgaagtaatgccgggccagctcgcggcggtgagcggtgagggtttcgaggtgggcgaactggcccaggccgatggcggccgcgacgtcggtcatgttgaatttgccgcccagcacgtccacgtccaggccgtcgaagccgtggcgggtcacgccctgcagtcggtacttctccgccaggcgagcctcttcggcggtgttcagcaccagggcgccgccttcgctgcaggtgacgttcttgttggcctggaaactgaaagagaccaggtcgccgccagcgccgatgcgctcgccattccagcttgagcccagtgcctgggcggcgtcttcgacgactcgcaggccgtgcttgcgcgccagggcgtagaggcgtgccatatcgaccggcaggccggcgagaaacaccgggatgatggccttggtccggggcgtgatggctgcttccacctgggccaggtcgatgttgcgggtgatcgggtcgatgtcggcgaacaccggggtggcgccgacttcgagaatcacgttggccgtggccacccaggagatcggcgtggtgatgacttcatcgccagggccgatgccggcgatacgcagggcgatctccatggtgcaggtgccggaattgaaggtgcgcaccgggcgcccgccgcagtactgcgagagttgcgcctcgaaggcctggaccttgggcccgctggtgatccagcccgaacgcagcacttcgccgacgctggcgatggtggcttcatcgatggtgggtttggagaacggcaggaaaggcagctggctcatgacgatgggatacccgataaacagtggtcgaggcagggcggcgggccgcgccggagtcgagcatcatgctaccggttcgcccggggggccacaccgtcggcgtccgggatcggctgctatgctgctttgaccgtgttccatcgacgccgagcgccgcctgagagagagcccgtcatgtcccagttgccgtccttgagccagttacgcgatcccaatgcctttctgcggcgtcacctcgggcccgacgccgccgagcagcaagcgatgctcgacagcctgggcctgggcagccgggtcgagctgatcgaacagaccgtgccgccgggcatccgtttcaaccgtccgctggacctgccgccagcgctggacgagcaggccgccctggccaaattgcgcggttatgccgagcagaaccaggtctggaccagcctgatcggcatgggttatcacggcaccctgacccccacggtgatcctgcgcaacgtgctggaaaatcccggctggtacaccgcctacacgccttaccaaccggaaatcgcccagggccggctcgaagccctgctcaatttccagcaactgaccatcgacctcaccggcctggaactggccaacgcctcgctgctggacgaagccacggccgccgccgaagccatggccctggccaagcgcgtggccaagtcgaaaagcaatctgttcttcgtcgaccagaactgccatccgcagaccctctcggtggtgcagacccgcgccgaagggttcggcttcgaactggtggtcgacagcctggacaacctcaagcggcatcaggtgttcggcgccttgttgcaatacccggacacccacggcgagattcgcgacctgcgaccgctgatcgatcatctgcacgcgcagcaggcgctggcctgcgtggccgccgatctgttgagcctgttgctgctgacgccgccgggcgagctgggggccgacgtggtgttcggttcgtcccagcgctttggcgtgcccatgggctacggcgggccccacgcggcgttcttcgccagccgcgaggagtacaagcgggcgattccgggacggatcatcggcgtgtccagggacgcccggggcaacgtggcgctgcgcatggccctgcagacccgcgaacaacatatccgccgcgagaaggccaactcgaacatctgcaccgcccaggtgctgctggccaatatcgccagtttctacgcggtctatcacggcccggaaggcttgcggcgcatcgcccagcgggtccatcgcctgacctgcatcctcgccgccggccttgaacgcaagggcatcgagcggctgaaccggcagttcttcgacaccctgacgctggaggtcggcggtagccagacggccatcatcgagagcgccaaggccgcgcagatcaatctgcggatcctcgggcgcgggcacctgggcctgagcctggatgaaacctgcgacgagagcaccgtcgcccggctgttcgatgtgttcctcggtgccgaccacgggttggacgtcgcgcaactggatgctgaaaccctggtcccgggcatcccccaggacctgctgcgcagcacgtcttacctgagccatccggtgttcaacagccatcacagcgaaaccgagatgctgcgctatctcaagcagctggagaacaaggacctggcgctgaaccagtcgatgatcccgctgggctcctgcaccatgaagctcaattccagcagcgagatgattcccatcacctggcccggcttcgccaacctgcatccctttgtcccgccggagcaggccctcggctattcgctgatgatcgaggaactggagcgctggttatgcgccattaccggcttcgatgcgatctgcatgcagcccaactccggggcccagggcgagtacgccgggttgctggcgatccgcagataccacgagagccgccagcagggagagcgcaatatctgcctgattcccgcctcggcccacggcaccaacccggcctcggcgcagatggccggcatgcaggtggtgatcgtcgattgcgacgccgccggcaacgtcgacctgcaagacctcaaggacaaggcgcagattgcgggcgaacacctggcgtgcctgatggccacttatccttcgacccacggggtgtacgaagagggcatcagtgagatctgcgaggtgatccacagccacggcggccaggtgtacatggacggcgccaacctcaatgcccaggtcgggctgacacggccggccgatatcggcgccgacgtttcccacatgaacctgcacaagaccttctgcattccccacggcggcggtggcccgggcatggggccgatcggcgtgcgggcgcacctggcgccgttcgtggccaaccacccggtggtggccatcgacgggccgctgccgcagaacggcgcggtcagcgcggcgccctggggcagcgccagcatcctaccgatcagttggatgtacatcgccctgatgggcccgcagctggcggatgccagcgaggtggcgattctctcggcgaactacctggccgaacacttgagcggggcctttgcggtgctctacagcgggcgcaacggccgggtcgcccacgaatgcattctcgacctgcggccgctcaaggcgcagaccggcatcagcgaagaggacgtggccaagcgcctgatggactacggtttccacgcgccgaccatgtcgttcccggtgccgggcacgctgatggtggaacccaccgaaagcgagtccaaggccgagctggaccgttttatcgaggccatgctgagcattcgcgccgaaatcgcccaggtccaggaaggcaactggccggccgaagacaacccgctcaagcgctcgccccataccctggcggatatcgccggcgtctgggaacggccctacagcatcgagcaggcggtaatccccagccctcacgccagggcgcacaagtactggccgacggtgaaccgggtcgacaatgtctacggtgaccgcaacctgttctgtgcctgcgtgccggtggatgcctaccgctgagctcgaacggcgggcaaaaaaatgccgctcttgtgagcggcatttttcgttgcgtcagcctggctaccggctggcggtcactgctgggcgacggcgtttttcgccaggatggcgttggccaactccatgtcggtggccagcaggcccgggttgtcggcacggactttctgcatcgcggattccaggtacggaccgcggatgttgccttcgctggcgacgaagctgctggcgtcgtcctgggcggcggcgatcagcttgtgatccttggaagtcaggtaggtggaagcggtggtggcgccggtggaaaggacgttacgccagaagctgtcggccattgccgaacctacaggcagggaaagcagggccagggtggcgacagctgttttgaaacgcatggtgggtgactccagctagggggaaaaactgagccctttgataggcattggctcgattgagttccctgctgctccaacaagctttcgcctgtgaggacaggggctgagcggtacttcggcgttgagtcggcgcactggaatgcagcagtggcgtttgacaccatgggcgactttctcgactgcacggatgcttgccttgacctttggcgcgatgatgtatgtaaccctgatgaatctggtgtttctgtcctttatcggacttcctttgttgttggctgccttgctcattccgacctaccgacgccagatgcgccgccagcccctgcggttcggcgcacttggcgtggcatgtgccgtcatcgtggtttgcgtactgtggaaaatccaccgggacaatcaactgaataaggcgcaccacccgcaacttgagcaggacgtacagcttgatggcctgccattgcccgcaggtgccaagctgaatctgcgaacacttgaacctctggatgtgcaaggccggccgcaacctcatggattgcgcagcctctattacgccaaattcgcttcgccacacaccatcaacggtgtggaggttacagagttgcagatgtacggcagcggccctttctcaaagatgctgctgagccgtgaccaggtcgttgcgggctggccctgcgccggcggcacctgggtaacgctggacattgccgacgaggaccgcttgcaacccagccgctggcgtttctctgcctgcaggctggtgaccggggccgatgtggcaggggtgacgtggccggactccagcgaggtcaggcagtacgacggcaggttcagcatcgacaccatcggtctgccttcaccggcggtggttatccaggggatagcgctgtcggacctgagcctggacctcgacgagcagcggcaacccggacgttggcgcgggcaactggcgcaagacctgaccctgggcgattggcactacccccgcggcatgagggttcgccaggacacgccggggaccctgatgttcagcccgagcaagtcggactgcgcgcagaacctgcgtacgggggaaacgctcgacgcggggcactcgatacagcaacgccgggagagcggcgcggtgctgtggatcaagcccaatgccgggttgggtgtactcgactggtagcgggatagctcatcgctgctcgctttgtggcgtgacccgcaatatttcctcgagggtggtcagcccggccgcgactttctgcgccccggacaggcgcaggctgcgcatgccttccaagaaggcctggcggcgtatggcgagcaggtcggcgtcggcgctgatcagggctttgaggctgtcgctcaactgcatgatttcatacaccccggcgcggccccggtagccggtatcgcggcattccaggcagccggtggcgccgtgggcatggttgggcagcggtgcctgccagggccgggtcaggctttgccagtcgccttcgtccagggtcagcggggtcttgcagtgcgggcacagggtgcgcaccaggcgctgggccatgactcccagcagcgtggccttgatcaggtaaggcgcgacgcccagttccagcagacggctgatggcgccgggcgcgtcgttggtgtgcagggtcgacagcaccaggtggccggtgagcgccgcctggatcgccatctccgcggtttccaggtcacggatctcgccgatcatgatgatgtccgggtcctggcgcatcagcgcgcgcacgccgctggcgaaggtcagctcgatgttgtgctggacctgcatctggttgaacgccggctcgaccatctcgatcgggtcctcgatggtgcagaggttgacctccggcgtcgccagcttcttcagggtggtgtacagggtggtggtcttgcccgaaccggtggggccggtgaccaggatgatgccgttgggctggcgggtcatttcctgccagcgccgcaggtcgtcgctggagaaccccaattggtcgaagtccttgagcagcacctcggggtcgaagatgcgcatgaccattttttcgccgaaggcggtgggcagggtcgacaggcgcaattccacttcgccgccttccggggtcttggtcttgacccggccgtcctggggtttgcgtttttccgcgacgttcatccggcccaggcttttcaggcggctgaccacggccatggtgacttggggcgggaactgatagacgttgtgcagcaccccgtcgatgcgaaagcgcacggtgccttgttcgcggcgcggctcgatgtggatatcgctggcccgttgctggaacgcgtactggaacagccagtcgacgatgttgacgatgtgcgcgtcgttggcgtcgggctcctgatcgctggcgccgaggttgagcagttgttcgaagttgcccggggcgtggcttttctggtcggcgctggcgccggtgaccgacttggccaggcggaagaactccacggtcaggcgctggatttccaccgggttggccaccacccgcttgatcggcagtttcaacacgtgggtcaggtcggcttcccaggcgctgacgtaaggctgggcgctggccaccgtgatcgcctcggcgtcgatcgacaccgcgaggatcttgtggcgctgggcgaaggcgtaggacatcagcggggtgacggcggcgacgtcgattttcagcgggtcgatgcgcaggtacggctggccggcctgttgcgccagccacagagtcaggctttccaggtccaggcgcctgccgggccggctgaggtcgtccaggtgctggctggcgagaaactccagcggatgcagctggctgttggcggcattacgacgggtggtcagggcgtgttcggccgagtcctggctgatgaaaccctgggcgaccaggtcgcgcagcagatcgttgagatccagccagtggtcctgggtaacgagaggaacggacatgcgggctccttgtgaacaatccggcagcaggcgggttagatgcgcctctgaccacgcaatgccaagaatagtcccgggatggcgaccgccagtcgcccaagcgttgcagggttttgcctggcgccctcagccggcggcctgcaacggctcgcgctcggccagttgcagctgtaccgaacacacgctgatcaggttgcgcagtttttccgcgatgacctgggcgcggtgccagctcaggccgtcgagcagcacttccatcagcagcgaaccgtcctgctgttgcacctggacctgctgcggcagcagggactgcagggcgaaatggttgagcacccggcacagcacatcggcttcggcgtcggtgaccagttggtaatgcacccggcaatgggtgttggcgacattccacacatcggcgcgggaactgacggcttcgagagagggcatggggttctccagatcaatggagaaatttttacattcggttgcgggtatttcttatctaagatgaacgtattttccggattatcgaattggatgattcgtctttaaggattattgagggttttctatgcatagcgagctggacgcttacgaccgccgcattctagcgctgctgcaagaggatgcttcgctgtccagcgcgcagatcgccgagcaggtgggcttgtcgcagtcaccgtgctggcggcggatccagcggctcaaggaggagggggtgatccgtggccaggtgaccttgctcgaccgcaagaagatcggcctcaacacgcagatcttcgccgaggtcaaactcaacgcccacggccgttccaacttcaccgaattcaccgaggcgatccgcggttttccggaggtgctggagtgttatgtgctgatgggcgcggtggatttcctgttgcgcatcgtcacggcggacatcgaggcgtatgagcgtttcttcttcgagaaactgtcgatggtgccggggattcaggaagtgaattcgatcgtggcactgtcggagatcaagtccacgaccagcctgccggtcctgcgttgatgccgttggtgctatcgcgagcaagctcgctcctacaagggattaccgccaacctgtaggagcgagcttgctcgcgatcaggccgttacatacgcagcaaggttttccatgcgcggttctggaacaccgtgatcgcctgttgcttgcgggcatccagggtttcgtcggtgatcggctcgttggccagttgcgccagcttgttcaactcgccgtacaggcgatccagctccgggatttccagcacattgcgcgcgtgatgcaaccaggactggatgcgttcgatgcgcggcagttgctcggccaggtcttccggctgttgctggtagcgtggcagttgcagggcactggcttcgtcggccagcaggcgcggcaaccagctgcccagttgcgccgcaccctgacggttgccacgggtattgcgctcggcggtccagctgcgggccagcaaccagcgcgaggtgttcagcgagaacaggccccagcgcacatcctgcaactcttcgatgaactgctcgggcgcggccttgcgcacgtcttcgtcgtccaggccggcttgcaccagcggacgccagtcttccagcaggccgtccagcgacgcgcgcaactcggcggtcgcctggcgcggtgcggcctggcccaggctgctgaccagggcgcgcaattccgccaggttctcgacccagtcctgcagcaggcgccagtgtccgttgaagcgatattgctcggccaggcgctggctgctgcccagcaggtgccaggtcagtgcggcgaaggcgtcgtccagcggcgtttgcgcgctcagttccggggccggcaggctcagggagtagctgttggcgtcgaacaggcggtaaccgcgctcggctttactgatgtcgcagggcatcagcggcagggtggcggccagttcggcggccagttccagcagggcggccggttcgccttcgcgcagttccagttccagctcgcagatctcttccttctgtttgccggcgatcacgtggcccaggtccagggcggcttcgatcaccaccttggccttgccgcggccccaggcgatttccgcgcgttcgcggacgaaatcggtggtgaagatcggcttgagggtcttcttgtccagctcggccagttgctcgggccagcattcgccgtcgagtttcttcaggtcgagcttggctttggccaggtgccagtcgtactcgttgcgttccgacaggccggcgacgctctggccgcgggtcttgagggtctggatcacttcttcgccgtcgcggcgcaggcgcagggcgaccttggcgcgggccaggtcgcgctcgggcgtgtcgaagtactggttcatcagttcgcggtgttcccagccacttttgttgcgttttttcaggagcgggtgctcacgcaggacggcgagggtttcgcggctgacgcggagtttgatttcggtttctttctgcatggccggaaaatccaggatcgggagcgcagccgggggaaatgtgtggctgccaaggtcgtgcagtgtacaggactcgccgcgtcgaggtgccgtggcggtttattcctgtcgcaggatggctctatgatggacttcatcttggaaccctggagccagcgcatgccattgccgtccatgaaagagcagttcgctgcgctgattgccacaccttcggtcagctgtacccagccggcgctggatcagtccaatcgtgcggtcatagacctgctggcgagctggcttggcgacctgggttttgcctgcgacatccaacaggtcagccccggtaagttcaatctgctcgccagtttcggcagcggccccggtggcctggtgctggccgggcacagcgataccgtgccctacgacggcgcgctgtggcagaccgatccgctgaagctcaccgaggtcgacggacgctgggtcggcctgggcagctgcgacatgaaaggctttttcgccctggtcatcgaggcggtccggccgctgctggatcagcccttcaagcaacctctgctgatcctcgccacctgtgacgaggaaagctccatggccggcgcccgggccctggccgaagccggccggccactggggcgcgccgcggtgatcggcgagccgaccgggctgcggccgatccgcatgcacaaaggcgtgatgatggagcgcatcgatatcctcgggcgcagcggccactcctccgacccgagcctgggccatagcgccctggaagccatgcacgatgccatcggcgaactgcgcggcctgcgtctggcgtggcagcgcgaattccgcaatccacagttcagcgtgccgcagccgaccctgaaccttgggtgtatccatggtggggacaacccgaaccggatctgcggtcagtgctcgctggagttcgacctgcggccgttgccgggcatggacccgcaggtgctgcgcgcggccatccgacagaagctggtgcccgtggccgagcggcatcaggtgcagatcgactacgcgccgctgttccccgaagcgccggccttcgagcaggccgaagactgcgaactggtgcgggtggccgagcgtttgaccggccatcgcgccgaagcagtggcgttcggcaccgaagcgccttatcttcagcgccttggctgcgagacagtggtactgggcccgggcgacatcgcctgtgctcaccagccgggggaatacctcgaaatgtcacgcttgcagcctaccgtgcatctactacgtgaactgattaaccattactgcctgacgccggcctgatttctactaaatcaccgacggccaagcccgtacctcaaggagagcgagcgtgtcgccaagcctgttccgacgataaccaccagcccgctgtgcgttttcccgtttcgtccttttataggctgcttcttatttacaggctcaggttatgcccgattacgtcaattggcttcgtcacgcttctccttatattaatgcccaccgcgactgcaccttcgtggtcatgctgcccggcgacggcgtagaacatccgaacttcggcaacatcgtccatgacctggtgctgctgcacagcatgggcgtgcgcctggtgctggtgcacggctcgcgtccacagatcgaagcccgcctagccgcccgtggcctgaccccgcattatcaccacggcatgcgcatcaccgatgcggcgaccctggaatgcgtgatcgacgccgtcggccagttgcgcatcgccatcgaagcacggctgtccatggacatggcgtcctcgccgatgcagggttcgcggctgcgggtcgccagcggcaacctggtgaccgcccggccgatcggcgtgctcgaaggcgtcgactatcaccacaccggcgaagtgcgccgggtcgatcgcaagggcatcaatcgcctgctggacgagcgctcgatcgtcctgctgtcgcccttgggctactcgccgaccggggaaatcttcaacctcgcctgcgaagacgtcgccacccgcgcggccatcgacctggctgccgacaaactgctgctgttcggcgccgagcgtggcctgctggatgaaagcggcaacctggtgcgcgaactgcgtccgcagcaggtgccggcgcatttgcagcgtctgggcggcaactatcaggcggaactgctggatgccgcggccgaagcctgtcggggcggagtggggcgcagccatatcgtcagctacgccgaagacggcgcgctgctgaccgagctgttcactcgtgacggtggcggtacgctggtggcccaggagcagttcgaactggtccgcgaggcggccatcgaagacgtcggcggtctgctggatctgatcagcccgctggaagaacaggggattctggtgcggcgttcccgcgaggtgctggaacgtgagatcgaacagttcagcgtggtcgagcgcgaggggatgatcatcgcctgtgccgcgctctaccagatcgccgattccgacgccggggagctggcctgcctggcggtgaacccggaataccgccacggcggtcgtggcgacgaactgttggaaaggatcgaaacccgggcccgggcccagggcctgaaaaccctgtttgtcctcaccacccgtaccgcccactggttccgcgaacgcggttttgcccctagtagcgtcgagcgtctgccttccgcgcgggcgtcgctgtacaactatcagcgcaactcgaagatcttcgaaaaagccctctgagcatcactcccttcggcaacccgctcttgacaggagcgggtttttgctgcgcccggctgcacgcgatttgtgtttcagaaaaataaatctgcgtgacacaaaaactgtaacaaattgacgcgaccatcggcgcgaagccattattgcgtcgcttttttgatactggttgacgtatctggcttatgttttaactgatcgatctaaagatcagcggggaaataccattcaggaatcagacggtacgccgataccttgtaccacggctcaagcaggcatacctgttgatattcccgaacggtatgaaaaagaatgaaataattctttttgggattatgaaaaactcattaccctgcaaggcgtaaatcatcgcgattagaccttggtcgtagacacagttggttacgattgacttatgagtcacggtctggcgctaatcgcccaccgatggacccggggcatcagaccctgggcctgagtacacaagaattagaaacgagaggagcgaaacatgaacaagtccaccttggccctggctgtggccgttggggttctggcgcagcaggcaggcgccgccggtttcatcgaagacagcaaggccactctgggtctgcgtaacttctatatcaataccgacaaccgtgatgccgacaccaaggcgtccggtgcgcagagcaagcaggaagagtggggccaaggcttccagctcaacttcacttccggttacaccgaaggcaccgtcggtttcggtctcgacgccatcggcctgctgggtatcaagctggattcgggcggcggtaccaacggcgcctctgctacttcttacggcggcaccgtcttcccgagcgagtccaacggcaaagcagtcgataactactccagcctgggcctgactgccaaagccaagatttctcagactgagctgaagctcggcaccctgcagccaaaactgcccgttatcgtgaccaacgatggtcgtatgctgccgcaaaccttccagggcggtcagatcacctcgaacgacatcaaggacctgacactggttggcggtcagatcgagcatgccaagggccgtaactccagcaacaacgaagaactgtcgattgccggcgccaacgcgcacaccgctgctggtcgcgacagcaacaagttcatctacggtggtggtgactacaagatcactaaagatctgaccgctcagtactactacggcaacctgaaagacttctacaagcagcacttcgttggcctgctgcacaactgggctatcggtccgggcgtattgaagtctgacctacgctacttcaacagccgtgacgacggtgccaacggccacgactcggcctactacaccacgggcgactacggtaccggcatcaccaagggcaaggttgataacaacctgatcagcggcttgttcctgtactcggttgccggccataccttcggtggtggctaccaggtcagtaacggtgacagcgatttcccttggctgaaccagggtgatggttcgtcggcttacctgactaccgacatgcagatcgccaagttcgcccgtgctggcgaacgtacctggcaagctcgctactcctacgatttcgccaaggtaggcgtgcctggcctgaccgccggtgtgatctatctgcgtggcgacaacatcgatacgactggccgggagggttccgttacccctcagcgttccgtttcggttaccaacgccagcgagtgggaacgcgacctgaccgtggcctacgtgattccggaaggtccactgaaaaacctcggcctgacctggaaaaacgccatgtggcgtaacgacattccgggccagcgctcgcaggacgaaaaccgcctgatcgtcagctactcgatcccgctgttgtaatccgacgttaaaacctcgcccggcgcaatgccgggcgaggtgttgtcatccaggtcggacccacccccgcaggtcctccccgaaacccctctttacagctactcaaggccttctcgaaccttgtcgaggatggtgtgccctgggcgtgtgcgaatccagtgaagagatttttaatattcacttatggtctaaataaatcgatatttattctttttaaatattcccaggcgcaggcacagtagggcccataacgcactcacaggagcagcaacatgagcctcagacttggcgacatcgcccccgacttcgaacaggattccagcgccggcaagattcgcttccacgagtggctcggcgacagttggggcgtgctgttttcccatccggcggacttcaccccggtatgcaccaccgaactgggattcaccgccaagctcaaggagcagttcgcccagcgcggcgtgaaagccattgccctgtcggtggacccggtggactcgcaccacaagtggatcgaggacatcaacgaaacccagaacaccctcgtcaacttcccgatcctggccgacgccgaccgcaaggtctcggacctgtacgacctgatccacccgaatgccaacgacaccctgaccgtgcgttcgctgttcgtcatcgacccgaacaagaaggtgcgcctgaccatcacttatccggccagtaccgggcgcaacttccacgagatcctgcgggtgatcgactcgctgcagctcaccgacaactacaaggtggccaccccggccaactggcaggacggtgatgaagtggtgatcgtgccgtcgctcaaggacgaagaggaaatcaagaaacgcttccccaaaggctatcgcgcggtcaaaccctacttgcgcctgactccgcaaccgaatcgctaagccattttcgattacgcggcggcgtgttgctgtaggagccagcttgctggcgatggggccaacacggcgtgtcaggtacgccgcttcgcgagcaagctcgctcctagaaagattgatgtatccacaaagcaggggttttaaggccgtttcgacggcctatttttttgcctggaaaacggcttttcttatattcatttaaagaataaacaaatgaaaaaataagatttatggatatataaatagactgttaaggtctgctcagctcagcgagatcgcaaaccgcgaatcgcccattactgctaaaggaaacctctgcatgctggtcgtctcactcggtggcagtcccagccaacgctcccgctccggggtgctgctggaacacgccaaacgctggttgcagcaacaaggtgtggaagtggtcgcctatcaggtgcgggatttcccggccgaggacctgctccacgcgcgcttcgacagcccgatggtgatcgacctgttgcaacagatcgaacaggccgacggcctgctgatcgccaccccggtctacaaggcgtcattttccggcgcgctgaaaaccgtgctcgacctgctgccggaacgcgccctgaaccacaaggtggtgctgccgatggccacgggcggcagcatcgcccacatgctggcggtggactacgcgctcaagccggtgctgtcggccctcaaggcccaggagatgctccagggcatcttcgccgaggacagccagatcgcctacggcgaaggcagcgcccaggcgcagctggcgccggcgttggagcagcgtctgcgcgaagccctggaacagttccacagcgccatggcgcggcgtcccaagccgctggacccgaatctgttgaatgaccgtttgttgagtgctcgctggagcatttgagtcctacccgattctgaagtactgaccttacttagccgccaacggcctagcaggtgcagccaaaacccaacagcaaaaaggagagcgccatgcgccctgtgattttgcgtcgtggtctggtcgctctgtttgctgcggctgtgtccttcggcgccatcgttcaagcccaagcggccgaaaccctgcgtatcggctatcagaaatacggcaccctggtgctgctcaaggccaagggctcgctggagaagcgcctggcggagcagggcgtgcaggtgcaatggaccgaattccccggcggcccgcagctgctggaagggctgaacgtcggctccatcgacttcggcgtcaccggcgagaccccgcccgtattcgcccaggccgccggtgccgacctgttgtacgtggcctacgagccaccggcgccgaccagcgaagcgatcctggtccccaaggattcgccgatcaagtcggtggcggagctcaagggcaagaaggtggtcctcaacaagggctccaacgtgcactacctgctggtccgcgccctcgaagacgccggcctcaagtacagcgacatccagaccgtgttcctgccgcccgccgatgcccgcgccgccttcgagcgtggcagcgtcgatgcctgggtgatctgggacccctatcaggcggcggccgagaagcagctgcaagcccgcaccctgcgtgacggcagcggcatcgtcgacaaccaccagttctacctggcgaccaaaccctacgcgcagcagcaccccgaggtgatcaagaccctggtggaagaagtgcgcgcggtgggcgagtggtccaaggccaacccggacgaggtgacccagcaggtggcgccactgctcggcctgccggcggacatcaccctgacctcggtgaaacgccagggctatggcgcgcacttcctgaccccggacgtggtggcggcccagcagaaaatcgccgacagcttccaccagctcaagctgattcccaaacccctgagcatcaaagacgtgatctggacgcctccagccgccgttgccaaagcgccgtaactcgatccccttaggagacaactccatgagcctcaatattttctggttcctgcctacccacggcgacggccattaccttggcaccgccgaaggcgctcgcaccgtcgaccacggctatctgcagcagatcgcccaggcggccgaccgcctcggtttcggcggcgtgctgatccccaccggacgttcctgcgaggactcctggctggtggcggcctcgctgatcccggtgacccagcgcctgaagttcctggtcgccctgcgccccgggatcatttctccgacggtggcggcgcgccaggcggcgaccctggatcgcctgtccggcggccgggcgctgttcaatctggtgaccggcggcgacccggacgaactggccggcgacggcctgttcctcagccatgaagagcgctaccaggcttcggtggaattcacccgcatctggcgccgggtgctggaaggcgaaaccgtcgattacgacggccagcacatcagcgtgaagggcgccaagttgctttatccgccgatccagcaaccgcgtccgccgctgtacttcggcggctcttcggaagccgcgcaggacctggccgccgagcaggtggacatggtcctgacctggggcgaaccaccggccgcagtggccgagaagatcgagcaagtccgggccaaggccgccaagcaggggcgcagcgtgcgcttcggcattcgcctgcatgtgatcgtgcgtgaaaccaacgccgaggcctggcaggcggccgagcgcctgatctcccatctggacgacgacaccatcgcccgcgcccaggcgtccctggcgcgcttcgattcggtcggccagcaacgcatggcggccttgcacggcgggcgccgcgacaagctggaagtcagccccaatctctgggccggcgttggcctggtgcggggcggcgcgggcaccgcgctggtcggcgatggcccgaccgtggcggcgcggatgcaggagtacgcggaccttggtatcgatacctttatcttctccggttacccccacctggaagagtcgtaccgggtggccgagctgctgttcccgcacctggatatcgaacgtcccgagctgcccaagggcgccggctacgtcagcccgttcggcgaaatggtcgccaacgacatcattcccaaagctgcgtcccagagctgaggcgcggccatgaacagacaaaccttgttccatcgcctggcgccctgggccctgccactgctgttactggcggtgtggcagttgtcggtctcggccggctggctgtcgacgcggatcctgccggcacccagcgcggtgatcgaagccggggtcggcctggtgcgcagcggcgaaatctggacccacttggctatcagcggctggcgcgcggcgatcggtttcctgatcggcggcggcatcggcctggccctgggctttatcaccggcctgtcgaagtggggtgagcgcctgctggacagctcggtgcagatgatccgcaacgtgccgcacctggcgctgattcccctggtgatcctgtggttcggcatcgatgagtcggcgaagattttcctggtggccctgggcactctgttcccgatctacctgaacacttatcacggcatccgcaacgtcgacccggcgctggtggaaatggcgcgcagctatggcctgtccggcttcgccctgtttcgccaggtgattctgccgggcgccttgccttcgatcctggtgggcgtgcgtttcgccctgggctttatgtggctgacgctgatcgtcgcggaaaccatctccgccagctcgggcatcggttatctggcgatgaacgcccgggagttcctgcagaccgacgtggtggtactggccatcgtcctgtatgccgtgcttggcaaactggcggacctcgccgcgcgcggcctggagcgtgcgtggctgcgttggcatccggcctatcaagtggccaagggaggtgcgcaatgacggctcaacaacctccacgcctgctgcgcggtattccgctggtggtgcgcaaactgcaaaagaccttcggttcgcgccaggtgctgcgcgagatcgacctgcatattccggccgggcaattcgttgcggtggtcggccgtagcggctgcggcaagagcaccttgctgcgcttgctggccggcctcgacaaacccaccggcggcgaactgctggccggtgccgcgccgctgagccaggccatcgaggacacccgcctgatgttccaggaggcgcgcctgctgccctggaagaaagtcatcgacaacgtcggcctgggcctcaagggcgattggcgcccgcaggccctggaagccctggaggcggtgggcctggccgaccgcgccaatgagtggccggctgccttgtccggtggccagaagcagcgggtggccctggcccgggcgctgatccaccagccacgcctgttgctgctggacgagcccctgggcgcgctggatgccctgacccggatcgagatgcagcaactgatcgagcgcctgtggcagcagcatggcttcaccgtcctgctggtgacccacgatgtcagcgaagcggtggcggtggccgaccgggtgatcctgatcgaagaaggcgaggtcggtctcgatctgctggtggagctgccgcgcccacgggtgcgtggctcccatcgattggcggcgctggaagccgaagtactcaaccgcgtgttgtcgctgcccgggtcaccgcccgagccggaacccgtttcacccttgcccacgcaattgcgctgggctcagtaacaacctcacaccctctaccacgacaggaatcaacatcatgactatcaaggccatcaacgttcgcaaccagttcaaaggcaccatcaaggaaatcgtcgaaggcgacgtgctctcggaaatcgacgtgcagaccgcctccggcatcgtcacgtcggtgatcaccacccgttcggtgcgggagctggagctggcgatcggcagcgaagtaatcgcgttcgtgaagtccaccgaggtgtcgatcgccaagttgtaatcggtgcgcgacaaccggccccggatggcgtgagcccttcggggcttttttgtgggcgatgacggctacagggccgggcgcttgggcaggtaaggcggcaggtacagccccaggtaggcatcgaacacccgcatgccttcttcggccatgcgctcggtgatctgcccatgctgctggactgagcgcgcgtagacgcggtcgcccagttccatggccagggcgaacacatcgacgtccgcgggcaataccggcaactggaagtgctggtcgaacagcttgtgcatcaggtcgcccagttcgatgtcgtgctggcggtcggcctgggtgacctcggtgaggccatgctgggccaggatcaactggcgggccgcggcgtcggcgctgtagatggcgagcatgcgctgttcgaccagccgcgacaggtcgtgccagctgcccagggcggcgtggtcgatgggttcttgcaggcaggcgcggaaggctgcgtggacgtcggcggtcagggcttcgagcagggcgggaacgctggcgaagaagtggtagaccgaggagggcggaatctccgcgcgctcggccacgctgtagatcgacaggctggccacgccctcggcggcaagcagggtgcgggcggcatcgagtatcgagtcgatccgggcctggctgtgtgcgcggggtttgcggggggtggctacgcgtgtcatgggagtctcctgcggggcagcgggcattgtacgcgaggtcataggcacggtcaggcgcgatcgttgtagccgctgccgcaggctgcgacaaggcccgaagggccttccgaggccctcagcgtctcctgcggaaccggtcgcagccctgcggcagcggctacagcggccataaaaaaaccgccacgggcctttgcggccggtggcgtttttttgctgcagccgcttacacggtatgcaggtaccagttgtactcgaggtcggagatcgagtgctcgaactcctccagctcgctttctttacaggccacgaagatatcaatgtatttcggatcgatgtacttggccatgacttcgctgtcgtccagctcgcgcaatgcatcgcgcaggttgttcggcaggctctgctcgttctgctcgtaggagttgccttcggttggcgcgcccggttcgaccttgttgaccagaccgtggtgcacgcccgccagcaccgaagccatcagcaggtacgggttggcatcggcaccggcgacacggtgttcgatgcgcacggcatcggaagaaccggtcggtacgcggatggccacggtacggttgtccaggccccagctcggcgagttcggcacatagaactgcgcgccgaaacgacggtaggagttgacgttcgggcagaggaaagccatctgcgccggtagggtctcgagcacaccgccgatcgcgtgacgcagtgcggcgttctgctcgggatcctcgctggcaaaaatattcttgccgtctttgtccaggaccgaaatgtggacgtgcagaccattacccgcctggcctgggtaaggcttggccatgaaggtggtgtccatctcatggtcgtaggcgatgttcttgatcagacgcttgagcagtaccgcatagtcgcaagccttgatcgggtcggcgacgtggtgcaggttcacttcgaactgcgccggagcactttccttgacgatggcgtcggccgggatgccttgttctttcgcgccttcgagaatgtcctgcaggcagtcgacgtactcgtcgaggtcgtcgatcaggtagacctgggtcgaatgcgggcgcttgccggagattggcgagcgtggcggctgtggccggccattcacgttctcctggtcgatcaggtagaactccagctcgaaagccgcgcagatggtcaggcccagctcgtcgaacttggcaacgacctggcgcagcacttcgcgcgggtcggcgaagaaagggtcgccttcgagttcgtgcatggtcatcagcagttgcgcggtggggcgcttctgccagggttcattgcacagggtatcggggattggatagcagattcgatcggcgtcgccgatgtccaggcccaggccggtgctttccaccgtcgagccgttgatatccagagcaaataaagaggccggcaggttgatgcctttctcgtaaaccttgtggaggctggtgcgttcgatgcgcttgccgcgcaccacaccattcatatccgcaatcagaaggtcaacgtacagaacctcaggatgttccttaaggaacgcgttcgcttcgttaagctgaacggcacgcgggggtaccgacatgatgcaacacctttgttaagaatagctgttgttaaaaatatcaatcattgagcttttctagtttcagtcaacccgaacagcatgccgaagtcaagcgaggccttttttgccctaaaaaagcgcctgcggggcatttttggggcgcttttctggcttcggagggcttggtcgccgcggccttgagcgggccgtgttgtattttttacgggggtgttgtgtaaaaaaatgaacaaggctaagctcgatttaaacccataacagcaataataccggggtgtttcatgtctcgcctgccgttaatcggcgtcaccgcctgctccaggcagatcggtctgcatgcttatcacatcagtggcgacaaatacgtccgcgcagtggcagtagcagccaagggcgtgcccatgatcctcccgtccctggccgatattctgagcccgtccgatattctggacggtctggatggcatcctctttaccggttcaccctccaatatcgaaccttttcactatagcggtcccgccagcgcgccgggaaccgcgcacgatcctgcccgtgatgccagcaccctgccgctgatccgcgccgcggtggcggccggggttccggtactggggatctgccgcggttttcaggaaatgaatgtggccttcggcggcagcctgcatcagcgggtccacgaggccggcccgttcatggaccaccgcgaggacgatagccagccggtggaagtgcaatacgctccggcccatgcgctgcatgtacagccgggcggggtgctggccggcctcggcctgccggcgcagattgaagtcaattcgattcatggccaaggcgttgaacgtctggcgccgggcctgaagatagaggccctggcacccgacggattgatcgaagccttctctgtcgagggggcgccgatcgagggaggcaaggcttttgctttgggggtgcaatggcaccccgaatggcaggtaagctctaaccctcactacctcgccatcttccaggcatttggcgatgcctgtcgccagcgggtaatgcaacgcgacgccaatgcgtcacaaaaacctggcttataagagccaggaaactcacgcctagaggcatttatgagtaacaacctcgaccagctcaccgattggttgaaagaccacaagatcacagaagtcgaatgcatgattggcgacctgaccgggatcacccggggcaagatctcgccgaccaacaagttcatcgccgaaaaaggcatgcgcctgcccgagagcgtgctgttgcagacggtgaccggcgactatgtcgaagacgacatctattacgaactgctggacccggccgacatcgacatggtctgccgcccggaccagaacgcggtattcctcgtgccctgggccatcgagccgaccgcccaggtgatccacgacacctacgacaagcagggcaacccgatcgagctgtcgccgcgcaacgtgctcaagaaggtcctgaaactctacgccgaccacggctggcagccgatcgtggcgccggagatggagttctacctgaccaagcgcagcgacgacccggactacccgttgcagccaccggtcggccgctccgggcgcccggaaaccggtcgccagtcgttctccattgaagcggccaacgaattcgacccgctgttcgaggacgtctacgactggtgcgaactgcaggagctggacctcgacacgctgatccacgaagacggcacggcgcagatggagatcaacttccgtcatggcgacgccctgtccctggccgaccagatcctggtgttcaagcgcaccatgcgcgaagccgcgctcaagcacgaggtggccgccaccttcatggccaagccgatgaccggcgagccgggcagcgccatgcacctgcaccagagcatcatcgacatcgagaccggcaagaacgtcttctccaatgaagacgggaccatgagccagctgttcctcaaccacattggcggcctgcagaagttcatccccgagctgctgccgctgttcgcgcccaacgtcaactcgttccgccgcttcctgccggacacctcggcaccggtgaacgtggagtggggcgaagagaaccgcaccgtgggcctgcgcgtgccggatgccgggccgcagaaccgccgggtggaaaaccgcctgccgggcgccgacgccaacccttacctggccatcgccgccagcctgctgtgcgggttcatcggcatggtcgaaggccacaacccgagcgcgccggtggtcggccgcggttacgagcgccgcaacctgcgcctgccgttgaccatcgaggacgccctggagcgcatggaaaacagcaagaccatcgagaagtacctgggcaagaaattcatcactggctacgtcgcggtcaagcgggccgagcatgaaaacttcaagcgcgtcatcagttcgtgggagcgggaattcctgctcttcgccgtctgatgcgcggggcgccgctgtcaccggcggcgccctcaccggaaaatcaggagagttccaatgatcagcaacaacccgcaaacccgtgagtggcaaaccctcagcagcgagcaccacctggccccgttcagcgacttcaagcaattgaaggagaagggcccgcggatcatcaccaacgccgagggcgtttatctctgggacagcgagggcaacaagatcctcgacggcatggccgggctgtggtgcgtggccatcggctacggccgtgaagaactggccgatgccgctagcaagcagatgcgcgagctgccgtactacaacctgttcttccagaccgcccacccgccggcgctggaactggccaaggccatctccgatgtggcccccaagggcatgaatcatgtgttcttcaccggctccggttccgaaggcaacgacaccatgctgcgcatggttcgccactactgggcgatcaagggccagccgaagaagaaaaccatcatcagccgcgtcaacggctatcacggctccaccgtggccggcgcgagcctgggcggcatgacctatatgcacgaacagggcgacttgccgatcccgggcatcgtgcatatcccgcagccttactggttcggcgaaggcggcgacatgaccccggacgagttcgggatctgggcggccaaccagctggaagaaaaaattctcgaagtcggcgtcgataacgtcggcgccttcatcgccgagccgatccagggcgcgggcggcgtgatcgtgccgccagaaagctactggccgcggatcaaggaaatcctcgccaagtacgacatcctgttcgtcgccgacgaggtgatctgtgggttcgggcggaccggtgagtggttcggtagcgatttctacgacctcaagccggacatgatgaccatcgccaagggcctgacctccggttacatccccatgggtggcctgatcgtgcgcgacgaagtggtggcggtgctcaacgagggcggcgatttcaaccacggtttcacctattccgggcacccggtggccgccgccgtggccctggaaaacatccgtatcatgcgcgacgaaaaaattatcgagcgcgtcaaggcagaaacggcaccgtatttgcagaaacgcctgcgggaactgaacgatcacccgctggtgggtgaggttcgcggagtcggcctgttgggcgccatcgagctggttcaggacaaggccacccgtgcgcggtatgtcggaaaaggcgtcggcatgatctgccggcagttctgcttcgacaacggcctgatcatgcgcgccgtgggcgacaccatgatcattgctccgcccctggtgatcaccaaggaggagatcgatgagctggtgagcaaggcccgcaagtgcctggacctgaccttgagtgcgttacagggctaagtgctaggctctgagcggagtaccccacggtacttcgctcggggcggccataaaggatggggtcttctgttgaaagcccgccttggaacttgccagactaccgcctgtttttagttgcctggcaaccggtcgctgaacacaaggttaaaaagaataattggagcatgacgcatgaaggcaataggtatgaagaaagctggcaagaccctcctcgccatgtccctgatgggcgcgatggcggcagtggcccaggcagacgacaaagtgctgcacgtttacaactggtccgactacatcgcacctgacaccatcgcgaacttcgagaaagagtccgggatcaaggtggtctacgacgttttcgatagcaacgagaccctggaagccaaactgctggcaggcaagtccggttacgacgtggtcgtgccgtcgaacaacttcctggccaagcagatcaaggccggtgtttatcaggagctggacgtctccaagttgcccaactggaaaaacctgaaccaggatctgctcaaggcggtttcggtcagtgacccgggcaacaagcacgctttcccatacatgtggggttccatcggcatcggttacaacccggagaaggtcaaggctgcgctgggcgtcgacaagatcgattcctgggacaccctgctcaagcccgagaacatcgccaagctcaagggctgcggcgtgagcttcctcgactcgccaaccgaaatgctcccggtcgccctgcattacctgggcctgccgaccgacagccagaagaaagacgacatcaagaaagccgaagagctgttcctcaagatccgtccttcgatcacctacttccactcctccaagtacatctcggacctggccaacggcaacatctgcgtagcggtcggttactcgggtgacgtgcagcaggccaagtcccgcgccgccgaagccggcgacaaggtgaaagtcagctacgtcattccgaaagaaggcgccggcaccttctacgacatggtcgctatccccaaggatgcggaaaacgtcgagggcgcctacaagttcatgacctacctgcagaagcctgaagtcatggccagcatcaccaacgccgtgcgtttcccgaacggcaacgccgccgcaacggcactggtagaaaaagacatcaccagcgatccgggcatctacccaccagcagacgtgcaggccaagctgtatgcgatcgccgatctgccggccgccacccagcgtgagctgacccgcagctggaccaagatcaaatccggcaaataaaccggtttgaggcagcaaccgctggccgtcgtccccgcgagggcggtcagcggtgcaattaaatgacagaaagttttgctggatcggtttatcgaaggtaagttgcgcgccggttttgttgctgggcagctcttggctgtcatgtagtgcgggcaactcaggcccaattgttgagaggacctccacttgcctatttctttatttcgcaaagccatgctggtgggcgccggactgacgctggccgtcagcgctcatgctgcgccgaccgtgcatatttataactggtctgactatatcggtcagagcacattggcggacttcgaaaaggccaccggcatcaagccgctgtacgacgtgttcgattccaacgaaaccctggaaggcaagttgctcgccggtcgtaccggttatgacgtggtcgtgccgtccaaccacttcctgggcaagcagatcaaggccggggcgttccagaagctcgacaaggcgcagctgcccaactattccaatctcgatccggtgctgctcaagcgtctggaaaagaacgacccgggcaaccagtacgccgtgccttacctgtggggcaccaacggcatcggctacaacgtcgagaaggtcaaggccgcgctgggcgtggacaagatcgactcctgggccatgctgttcgagccggaaaacatcaagaagctgtcgagctgcggcgtggcttttctcgactccgccgatgaaatgctcccggcggtgctcaactacatgggcctggaccccaacagccagaatcccgacgactacaagaaggccgaagccaagttgctggcggtgcggccttacgtgacctacttcaactcctcgaaatacatctccgacctggccaatggcgaaatctgcgtggccgcgggcttctccggcgatgtgttccaggccaaggcgcgcgccgccgaagccggcaagggcatcgaaatcgcctatgtgattcccaaggaaggcggcaacctctggttcgacatgctggccattcccaaggacgccggtaacgtcaagcaggcccatgccttcatcaattacctgctcaagcctgaggtgatcgcccaggtcagcgattccgtcggttatgccaacccgaaccccaaggcgggcgagctgatggaccagtcggtccgcaaggacgaagccgtttacccggcgcaggagattgtcgacaagctgtacgtcaactcagagttgccgcccaagatccaacgactcatgacccgcagctggaccaaggtcaagtcgggcaaatagcgtcaatcgctcaaactatccagagttcgcccgcatggggcgaactgcaaattctgttgggagtttcgtaaatggcagttgcctccggcgcctacaagaaagccctcgagggcgaccagacaccgaagcaggtgttggtcaagatcgaccgggtcacgaagaagttcgacgagacgattgccgtggacgacgtgtccctggaaatcaagaaaggcgagatcttcgccctgctcggcggttctggctcgggtaagtccaccctgctgcggatgctcgcggggttcgaacggcccacggaggggcgcatctacctggacggtgtggacatcaccgacatgccgccctacgagcggccgatcaacatgatgttccagtcctatgccttgtttccgcacatgaccgtggcgcagaacatcgccttcggcctgcagcaggacaagattcccaaggccgagatcgatgcccgcgtggccgagatgctcaagctggtgcagatgagccagtacgccaagcgcaagccgcaccagctgtccggcggccagcgccagcgcgtggccctggcccgttccctggccaagcggccgaaactgctgctactcgacgaaccgatgggcgccctggataaaaagctgcgctcgcagatgcaactggagctggtggagatcatcgagcgcgtcggcgtgacctgcgtgatggtgacccacgaccaggaagaagccatgaccatggccgagcgcatcgcgatcatgcacctgggctggatcgcccagatcggcagcccgatcgacatctacgaaaccccgaccagccgcctggtctgcgagttcatcggcaacgtcaacatcttcgagggtgaagtgatagacgacgccgaaggccacgcgaccatcacctgcaaggacctggaccgcaacatctacgtgggccacggcatcagcacctcggtgcaggacaagtcggtgacctacgccatccgtccggaaaaactcctggtgaccccggacatgccgacctgcgaatacaactggtcgagcggcaaggtgcacgacatcgcctacctgggcggccactcggtgttctacgtcgagctgccgagcggcaagctggtgcagtcgttcgtggccaacgccgagcggcgcggcgcgcgtccgacctggggcgaccaggtgtacgtctggtgggaagacgacagcggcgtggtactgcgctcatgaacatgcgaaagctcaagcgccgcctcaatcgaataattcccggtggccgccagatggtcatcggggttccgttcctctggctgttcctgttcttcatgctgccgttcttcatcgtcctgaagatcagcttcgccgaagcggacgtggccattccgccgtacaccgagatctacagcttcatcgaccagaagctgcaggtgctgctcaacctgggcaactacgcgatgctcggcgacgacgaactgtatatcgccgcctaccttggctcgctgaagatggcgttcttcagcacgctgctgtgcctgctgatcggctacccgatggcctatgccatcgccagcgcccgcaaagagctgcagaccgtgctggtgctgctgatcatgatgccgacctggaccgcgatcctgatccgcgtctacgcctggatgggcatcctcagcaacaacggcctgctcaacggcttcctgatgagcatgggcttgatcgacgagccgctgcagatcctcaacaccaacctggcggtgtatatcggcgtggtctattcgtacctgccgttcatgatcctgccgctctacgccaacttggtgaagcacgataccagcctgctggaagccgcttcggacctgggttcgagcaccttcaacagcttctggaaaatcaccgtgccgctgtcgaagaacggcatcatcgccggctgcatgctggtgttcatcccggtggtgggcgagttcgtgatcccggaactgctcggcggtccggaaaccctgatgatcggtaaagtgctctggcaagagttcttcaacaaccgtgactggccggtggcttcggccctggcagtggtgatgctggcgatcctgattgtgccgatcatcctcttcaaccgcagtcaggccaaagaaatggagggcaaggaatgaagcgcttcagtttctcgaacctgatgctggtggtgggtctgctgttcatctacctgccgatgctgatcctggtgatctactcgttcaacgcctccaagctggtgacggtctggggcggctggtcggtgaagtggtacgtcggcctgctggacaactcgcaactgatgggctcggtggtgcgctccctggagatcgcctgctacaccgcgatcgccgcggtagccctgggtaccctggcggccttcgtcctgacccgtatcacccacttcaagggccgcaccctgttcggcggcctggtcaccgcgccgctggtgatgccggaagtgatcactggcctgtcgctgttgctgctgttcgtggccatggcgcaactgatcggctggccgcaggagcgtggcatcgtcaccatctggatcgcccacaccacgttctgcgcggcctatgtggcggtggtggtgtcggcgcgtctgcgtgagctggacctgtccatcgaagaggcggccatggacctcggcgcgcggccgtggaaggtgttcttcctgatcaccatcccgatgatcgcgccatcgctggcggccggcggcatgatgtccttcgccttgtccctggacgacctggtgctggcgagcttcgtctccggcccgggctccaccaccttgccgatggaagtgttctcggcggtgcgcctgggggtgaaaccggagatcaacgccgtggccagcctgatcctgctggtggtgtcgctggtgaccttcctggtctggtacttcagccgccaggccgaagagcgccgcaagcgcgccatccagcaagccatcgaagaggccgcggccgattcctggaagcagccggacgtgcgccgcgcacaggccccggaagcggcctgatacgcgacagccggaaggcgttgaccgtgacaagacatcgcccctgttcaggggcgatgtcgttttcgggggtagccgctgccgcaggctgcgatcgaccggaacggtcgcagcggtctcaaggtcgccgaggtccttcggacctcgcagcctgcggcagcggctacagcagaaaacgcctcggctcttcagcgagtcgtatgccgccagggcgtgcagtgaatagacataggccgttctggcattcagtgagatggcggtggccagggtggcggcaatctcttcacgggtggccccggccttgagtgccgcgtcgactggattgccagccaagctggctgctacgggtcaggcgccgttcaccacgggggttactgcgccgtccgcgccggcaacagcttcagggtgctgcgggtattggccgtgacctcttcttcgttgaagtgcgcctgctggtacaccccttcgatataggcctcggcctgatcctgatagtgcttgtcgaacagcacgccgctttgcccgaccgggttgacgctcaggctgtgggccggatcggcgaagtcgatcagacgccgggtggacggaccataggtcaccggccagggcgcggggccgatcttggccgattgattgttcggcacttcgtgggtgccgggtgcggcgaacgggccgacgttgaacacccggtccaggggcttctgcaggcccagcggatggccgtgggtcagggtatgcgcctggccccacagccatttcgtcgagtcgtcgccaaaggtcgccttgagatgagcgaggctggcgcgccaggcgaccctgacggtgtcggcgcggctttcctggcccagggtgttgcggttgtcccaccacggcgaatcggcggaggcggccaggcgtggcagcgcggcgtcgatcacccgggtggacagcagggtgtcgaagaaggcgtcgcccagctcgtcgtggaaggcggcgtcggtgaggttgaacaggaactggttgaacagggtggcgctggtggagtccagcgggtagtcgcctttccactgcgccagttgctccaccagcttgagctcctgcgggtcgctcaccacctcgcgcaggaccggcatcagcggcgccagcaggcgcgggccataggcggtggtggtgcccagctggagtttctggctggcttcgatatcccatttcacgctcttgtcgccgagctggcggtccagttgctggccacggtcggcgaggttgtagtaaccgggaatctccatgccgctgggcgagaccggctggaagttggccgaaacgatatagccgcgcgccgggttttcttcctgggggttggcgctgaacgggtagaagccctctttgtccgccagcgaggtgctgccgtcgaggataaacgtgcccttggcgccgatcgggcgtttcggcagcagtgccgcggcccaccaaccgatatcgcccttggcattggcccagacgatgttcaagcccggcgcctggaccttggacgcggcactgcgggccttggccagggtgtcggcgcggttgagctggtagaagccgtcgaggatcgggttcggcgtctcgaggaaggcccaccacatggtgatcggcgtcttgccggcattggccccgagcacgtcgttgacgatcggcccgtggggcgactggcgcaggatctgggtgaccggcggctggcccttcaccgcgatccgctgctcgctgttgaccaggtcgacccacttgccgcggtaccagacctggttggcattgttcgggttgaccttctcggcgatcaggtccagatcgtcgttctggaacatggtcaggctccagccgaagtccaggttgtggccgagaaaggcgaagggcaccagcgcctgatgatgaccgtagagttcgaagcccggtgccgacagctgggcctcgtaccacaccgacggcaccgcgaagcggatgtgcgggtcgccggccagcaacggtttgccgctcttggtgcggctgccggacaccgcccaggcgttgctgccctcgaattgcggcaggccggcgtcggccagggcctgttcgctcagccgggcgatggcgcccaggtcctgccagtcgctggcggccaggcttggcgtcagcgggccgtggcccttggccagggcgcccttgggctgccagtcgaggtcgaagactttcaggtagtcgctgccgagctggtcgcgcacgtaggtcagcagcggttcggtgcggaaggccgcggcgaagctgtaggccatgtagccggcaacgctgatgctgtcttcggcggtgaaggaacgcttgggaatccccaggacatcaaattcgatcggttgcggatggctgttctgatactggttgaccccgtccaggtaggcttgcaggcccttccaggcaggggactggcgatccagcccggcgacgtagctgtcggcgcgctcgcggatgcgcaggctgcggaatagcttgtcggtgtcgagcaatttggggccgagtatctcggccagctcgccgcgggccaggcggcgcatgacttccatctggaacagccggtcctgggcgtggacgtaacccagcgcgcggtacaggtcggtttcgttttccgcgcggatatgcggcacgccgcgttcgtcgtagcgcaccgtgaccgagccctgcaggcgctccagctcgacctggccctggcgcgacggctgcttgctgtacaggtaccagccccctcccgcggcaagggcgaggatcaggacgacgagtacggtcaggctgcgtttcatggcgactccttgttcttactgcgatttgcctgccgtggggaaggcaaacatttagcacaggccttctgtgccgggcatccgttgtctgcgaaaagtcaggaatgccttaatccgtctgtttcggccatggacaataacagcccaccgccaaggtgtgggtggcgctgaccgcgcggccttcgtgcagggcctggaggataggttcgataaaactgttgctggaattgcaggtcaggccttcgctgtaggggccgaaataggccagggtgccgttgcggtcccagatcgccacggccgggctggcggggatctgctccgagccgggcaggccgtcgaggattttcaggcggctcagggtggcgggcaactggccgtggctgccggccttctgtaccgagtagaactccacaccctgcgggccgtagtgttcgatcaactcggccaggtgctgctggttgccgacattgcacgggcaggccgggtcccagaaatgcaccaggcggatggcgcctttgccggccagcctgggcggcagttgcagggggtcgccggaaaacaccgcggtgtgttcgctgaaggtgcgcagaaaacgtccctggaaccagtcgtaggcgacccacagcaccccggcgcacaggagggcgagcaggctggcaagcagggtcgtgcggtagggcagacgcatacggatcattcctcgaaggtcgcgtagcttgccatgcttgccccgacagatgaatatcgcaggccgataaagcctgtttcgcgttccgcgccaccctgggaaaacccttatgcctgcgaccttcgaccccgaccttctgcgcgccagcctgcggcccctggccgaggcgcaaccgctctcggcccaggcgcaggcctatcagcgtttctatgggctggatctgccggtcaagcgtgggctggggcgtttcgcggttggtggttttgaggtggttggccaggtctggtggcccgagcagccggtggcgaccttgtttctgttgcacggtttctacgatcacatgggcttgtaccggcatgtgatcgagtgggcgttggagcggcagtgggcggtgattgcctgcgacttgccgggccacggcctgtccagcggcgagcgcgccagcatcgatgatttcgcggtgtaccaggcggtgctgcaaggcttgttcgacgaagcccggtccctcgatctgccccagccctggcacctgtgcgggcaaagcacgggcggggcgatcgtgatcgaccatctgctcaaccagggcgcgcagagcccggcccagggccaggtgatcctgctctcgccgctggtgcgcccgcgcgcctggggctggtcgaagctcagctattacatgctccggcctttcgtcaaaggcatcgcccggcgcttcagcgagaactccaccgaccccgatttcctgccgttcctgcagcgcgacccgttgcaacccctgcgcctgccgaccgcctgggtcggggcgctggcgcagtggatcaagcgcatcgaactggccccacgcagtagccggcagccgctgatcgttcaggggcaggcggacatgacagtggattggcagcacaacctgcaggtgatccggcagaagttccagcagccccaggtgctgatgctgcccgaggcgcggcatcacctggcgaacgaggcggcgcgcattcgccaggaatacttcgccttcctgaaccagcatctttgaaggtattcacgcgcctgtagccgctgccgcaggctgcgatcgaccggcacggtcgcgccgatcttgcgaccactgaggtcctacggacctatcgcagcctccggcagcggctacaagaggcgcttagggcgtgaggctggaagtgctctggccgacggccagcccggcgcggatcgcggcgagggcggcctggtagtaggccttgccttcggcggactcggcgaagttggcgaactcttccagctcggggtcggacaggtcgcgatagacgtacagcagggtgttgttcaggtcgttgccgatctgcgccatcagccgctggcgctggccgttgagcatgttctgcgcctggccggcacccagcaggccggggatcatctggctcaggctgtcggcagccacgccagcgatcgccaggctgacttcggcgccggcttcacgggccggcagcgcctgggccaggtggccgatgatcagctgacgggtatcgctggcctgcatcttcggcaggccctgggcgtttttcgccaactggtcgcggcgggttgccagcagttcggcggcaacgatcttgcgccccagcggcgactggaaaaacgtcagggccggtttcggatcggcgaggttctgccgcagctgcgcctgggcgcggcggtccatggcctgcggcgcaaagcgctggttgctgttattgaccagggcctgatagaccgctggtggcaggctattctggtaacgctgctgggcggcggtgagggcatcgttgaaatgcgcgcgttgttccggccagccggcgaccttgtacaactggtcgtggccgtctgcccaggcgggcaacacacagaacatcaacagtgaaaaaagcaaacggcgcataaggactcctgtcggcagcccactattctccggggcgaggcgatggttgtcgagaattcgtatcaggttcagtacgcaaactgtccgatcgaacgacgaacagaggcggcgccaggctgcttggtcagaattctctcgtggatctgtcggattcatctgggtgtggatactatgcgcgccatgcaaataccctctgatcaccccctgctgttacgcattgtcgatgacctggccacccgtggctggtcgcagcagaacatcttcctgccagaagccctgaccctggagctggcggccgagtgccgtaagcgcgcggccgaaggcgagctggcgccagcggcggttggccgtggcccagcgcaggagattcgcgaggggatccgtggcgatcatatccagtggctcgagcccggccaggccgactgctgcgatacctacctgggcttgatggacagcctgcgcgaggcgctgaaccgtgggctgttcctcggcctggaagacttcgaaagccacttcgcgctgtacccgccaggggcgttctacctcaagcacgtcgaccgtttccgcgacgatgaccggcgcatggtgtcggcggttatctacctcaaccaggactggctgccggagcagggcgggcaactgcgcatgtacttcgatggtgagacggtatacgacgtggatcccgccggcggccggctggtggtattcctctccggcgaggtgccccatgaagtcctgcccgcgacccgggagcgcctgtccttgacgggctggttccgccggcgtggcaacgagccgttctgatcatgcacaagatcctggtcagtcgctgcctgttgggccaccgcgtgcgttacgacggtggcgccagcgggccgttcgatcaactggcgagctggcaggccgagggccgggtggttgcgttgtgcccggaagtcgccggcggcttgccgacgccacgggcggccgcggaaatacctggcgggcagggcggtgaagtgctcgatggcctggcgcgggttatcaccaccgagggcgaggatgtcagcgccgagttcctcagcggcgcccggcaggcgctggagctggtgcgcgaacacgggattcgcatcgccgtgctcaaggccaacagcccgtcctgcggcaatctgctgacctatgacggcagcttcagcggggtcaaggtcagcggcgagggcgtcaccgccgccttgctcaagcgcgccggggtgcaagtgttcagcgagctggaactggccgaggccgccgcagccctggcggcgctctagcccctgtagccgctgccgcaggccgcgaaaggtccgcaggaactcagcgatatcacgctcgatgtggccgtgccggccgatctcggccttgcggcagcgactacaacatcaaggcttgggcggtttgctcgcatccatgccgaaccatttttccgacaacgccatcagccgaccatcggccttgatgcgttgcagcgcgccatcgaggctcgcctggaacgccgggttacctttctggaacgggatcgccaggctcagggtcggcccgaccttcgcgccttccttcaccggcaagcggctgtcgcgaatggcgtaggggatcagcaggcggtcgctgatggcggcgtcgagctgcttgtcggccacatccttgatgggttgctgggcgttcgggtagctgcgcaggtcgatgccttcaacggtgcgtgcctgctcagcgaactggctgccctgggccacgccgagggcctggccctggagcgcctgcaggctgcccagcgcgcgctgttcttccttgcgtacgatcaattgtgcgctggaataactgtaaggctcgctgaagtcgaaacgatccttgagttccggggtcattgctacgtgattgatggcgatgtcgtagcggccgctttcgacgccaggtagcaggtcggcagcgtcggcgaccacgaagtccgcccgcacatccagttcccgggcgagcagttggcccagctcgacttcgaaaccggtgagtttgccgtcgtccttgaagttgaagggcggggtgttggcttccagcgcgatacgcagttccccgcgatcgttcacatcgtcgatcagttcggcttgagcgtaagtgctcacaagaggtagcaaaagtatcaggccaggcaggaaacgcatggtcactccttgaatttatatgtgcgatgcgctgttcaggctcgctttgctatggtgttgattgcccttcgacaacgatatgccacgaagttgtcataaccgtaccgattttgcggaaaaactggagaatagaatgaaaacctttatatctcgtgctgcattggccggcctgatgctgggggcttcgatgctggcttgtgcggcggatattcctcgcaccaaggcgccggaaggcgcttctgtatttatcgtcaccccggtcaatggcgataccgtggccaagaccttcaaggtcaagttcggcgtcagcgacatctccctggcgcccgccggcgaccagactccgcacaccgggcaccaccacctgctggtcgacgtcgacaagctgccagccgaaaacatgccgatcccggccgacgcccagcatatccacttcggcaaggcccagaccgaaaccgagctgaccctggccccgggcaagcacaccctgcagctggagttgggcgacaagaaccacgtgccgttcgacccgccaatcgtttcggaaaagatcaccatcaccgtcaagtaagcgcggacggtaaaaactgcctgtaaacgaaactgcctgtaaataaaaagggaggccccagggcctcccttttttatggttcttcacggattaccgggaaagacgctcttgatcttcatgaaaaagaattcgctgtcccggtaaccgtacgccatccgcttgatgaccttgattcgattgttgatgccttccaactggcccgtatgcattggccagcgcacccggctgacgatgccccgccagtaacccttcagtcgtttggcaaactggatcagaggcggtatgtcgctttcatgcgcatggcgcagccattgtcgccaggctgatcgccagccccaggcggtgctcggtgtccaaagcgttttgagttcagccttcatcaaatagaccgtcatcaacgcttggttggccgccagcagatcctccaggcggacttgttgttccggcgttttcaggttctgccgattgcgcagcaacagccatcgcgcctgcttgatgaccgtgcgggcaggcttgtcgtgacgtagccgattcgcttcatcgacgcggactcgatcaatcacctctcgaccatacttggccaccacatggaagaggtcgtagaccacgcgcgcttttgggcagtgctgacgaacctccaggtcaaaggcagtgttcatgtccatcgccaccgcttcgatgcgagcgcaaccctctgaccccagctcttcgaaaaagggtctgactgccgcccggctgcggccttcgccaatccacagcactcgccgggtatcggcgtccagcactacgctggcgtaacgatgacctttgaacagggcaaattcgtccatgaccaagcgctgtggctgcgcctttggcaaaacactcaatgccgcttgcaaggcgcgacgttccagcaagcgaacgctgtcccaatgcaacccgaacagttgggccacgtgtagcgtgggaaggcgctcgcaggcctgaatgaccgcatcggccaggcggcgcgtcatgcgggcatagcgatccagccaactgacggcctccatgcgtttgccacagtcccgacagccgacacgccgaagcaaaacgctgaggcgcactgctcggccaagaatgggcagatcgcggatgactcgctggcagtactcatgcgtggttgaacagagtttttggcagccgccacaggaagggaatcgggtggcgtggggaatcagatcgatctggagcgcgtcaccatcaggcttgatcgtgacgacagaaaagccctcccaaaagggaaggaaagtattaatatcacgcataagaacgccggtttgttagatgtgtttgctcgcacgaacatcatcaatcaaatcggcgttcttgtttctgtgtttcccgggattccgtgaagaaccttttttattgccagcgagtgcttagaacagcacgcggctgcggatggtgccgttgacgtgttgcagcttctcttgcgccagctccgagtattcggcgtcgacgtcgatcaccacgtagccaaccttctcgttggtctgcaggaactgaccggagatgttgatgccgttttcggcgaagaccttgttgatctcgctcatcacacccgggatgttctcgtggatgtgcagcaggcggtgcttgccagggtgagccggcagggccacttccgggaagttcacggacgataccgaagtaccgttgtcgctgtacttgaccagcttctccgccacttccaggccgatgttggcctgggcttcggcggtcgagccgccgatgtgcggggtcaggatcacgttgtccaggccacgcagcgggctttcgaactcttcgtcgttggagcgtggctccaccgggaacacgtcgatggcggcgccgatcaggtgcttgtccttgatcgctgcggccaggtggtccagctcgaccacggtgccgcgggcggcgttgatcaggattccgcctttcttgatggcgcggatttccttctcgccgatcatccactgggtggcagcggtttccggaacgtgcagggtgacgatgtcggacatgcccagcagctcgtgcaggttgccgacctgagtggcgttacccagcggcagcttggtcacggtgtcgtagaagaacacctgcatgcccaggccttcggccaggaccgacagttgggtgccgatcgagccgtagccgacgatgcccagcttcttgccacggatctcgaaggagttggccgcgctcttgatccagccgccacggtggcaggaggcgttcttctccgggataccgcgcagcagcaggatcgcttcggccagcaccagttcggctacggaacgggtgttggagtacggtgcgttgaacaccgcgatgccgcgctcgcgagccgcgtcgaggtcgacctggttggtgccgatgcagaagcagccaacagcgacgagcttcttcgcgtgatcgaagatttcttcagtcagctgggtgcgggagcgaatgccgatgaagtgcgcatcggcgatcttttccttcagctgggcttccggcagagaaccggtgaggtactcgatactggtgtagcccgcggccttgaggacgtcgacagccgattggtggacgccttcgagaagaaggaacttgatcttgctcttatcgagagaagtcttgctcatctgcgtaaacctgtgtcccggagaaaaatggcaggaaatggtcaacagatgctgacccggacggcaggaaagccgtcgccgcagaacgcccttcggcactattctgcggggggtcgtatgctagcatacggaccccgcgaaacactcgttcctgcgacgtgaagcgttctcaggatgaccatgaattgttcgagagttctgtcgatgaccaatcctgcgctgattgatgagctgaagaccctggtcgaggctggcaaggtcctgaccgatgccgactccctgaatgcttacggcaaggattggaccaaacacttcgccccggcgccgagcgccatcgtctttcccaagaccgtcgagcaggtccaggccatcgtgcgctgggccaaccggcaccaggtcgcgctggtgccgtccggcggccgcaccggcctgtcggccgccgccgtggcggccaatggcgaagtggtggtgtctttcgactacatgaaccagatcctcgacctgaacctgaccgaccgcaccgcggtctgccagccgggcgtggtgaccgagcagttgcagaaccgcgccgaagaaagcggcctgtattatccggtggacttcgcttccgccggttccagccagattggcggcaatatcagcaccaatgccggcgggatcaaggtgattcgctacggcatgacccgcaactgggtggccggcctgaaagtggtcaccggcaagggcgacctgctggagctgaacaaggacctggtcaagaacgccaccggctatgacctgcgccagctgttcatcggcgccgagggcaccctgggcttcgtggtcgaggccaccatgcgcctggaacgcgcgccgaacaacctcacggcgatggtgctcggtacgccggatttcgactcgatcatgccggtgctgcatgccttccagggcaagctcgacctgaccgccttcgaatttttttccgacaaggccctggccaagatcctcggccgcggcgacgtcccggcaccgttcgagaccgcctgcccgttctatgtgctgctggagttcgaagccagcaacgaggacgtggccaacgacgccttggccaccttcgagcattgcgtggagcagggctgggtgctggacggcgtgatgagccagagcgagcagcaactgcagaacctgtggaaattgcgcgagtacatctccgagaccatctcccactggaccccgtacaagaacgacatttcggtcacggtgtcgaaagtgccggctttcctgaaggatattgacgcgatcgtcgcgcaaaactacccggacttcgaagtggtctggtatggccacatcggcgacggcaacctgcacctgaacatcctcaagccggacgacctgagcaaggacgagttcttcgccaagtgcgccaccgtcaacaagtgggtgttcgaaaccgtcgagaagtacaacggctcgatttccgccgagcacggggtgggcatgaccaagcgcgattacctgacctacagccgttcgccggtggaaatcgactacatgaaggcggtcaaggcggtgttcgacccgaacggcatcatgaacccgggcaagattttcgctgtttgacctcagggtcactcaagcagcggtacctgatgaaccaaacgagcaggagtcggtaatgagctatcagcaccagtatgtcgacggtacccgtattcatttcccggtcggcaagatcgtgtgcatcgggcgcaactatgccgagcacgccaaggaactggacaatccggtgccgagcgagccgctgctgtttatcaagccgggcagttgcgtggtgccgctggaaggcggttttgccatccccaccgagcgtggctccgtgcattacgaggcggaaatcgcggtattgatcggcaagccgctgtcgacccagcccagccgcgaagaagtgctggatgccatctccggtttcgccccggccctggacctgaccctgcgcgacaagcaggccgagctcaaggccaagggcctgccgtgggaaatctccaagtgctttgacggcgcctgcgtgctggcgccctttgtggtcggcagtacgttcccggacctgaccgacatcaatattcgcctgaccatcaacggcgaggtccgccaggacggcaacagcagcatcatgctcaacccgatcgtaccgatgatccagtacatggccggctgcttctccctgcaggcgggcgacgtgatcctgaccggtacgccggtgggcgtcggtccgctgaacgtgggcgacgagctggtgctggagctgccgggcgtcagccgcttcgaaagtcgcgttagctgactcagcggggcccgcctgcaatgggcgggcctctcctaagaaagcgcggaaatccaggatatttctgactttttccgaatttttcacatccggtctggataattttccgcgtccaggcgtctgagtctgcccctatgtgctattaccaatagctgactttttggaacgcgctccccatgtccatgcctcacacccccgagcttcaaacggttcgccgccgcggattgttcgccatgcgctggtattcctggctgctgctgtcaggcgtggtgatgtatggcgtcgcgatcgccatgcactgggacgaccgtggcctgctctgggtgctggagcgtttcgaaactccggccgaacgccaggaaagtgtctggctgccggattaccgcgcggtgatcgacgccaaggtactgccgggcatggagaaggacgaggcctccgacctggcctacaacccgcagaccaagaccctgttttcggtgatgggcaagaacccgttcctggtcgagttgaacctgcagggcgatgtgctgcgcaagatgccgctggtgggctggagcaacccggagggggtgacggtcatggggaacggcctgctggggattgtcgacgagcgcgatcacctgctgaccatcgtcaaggtggatgccaatacccgcgagctgaatatttccgacttcccgaaatacgacctggggccttcgcaggaccagaacaaggcattcgaggccgtggcctgggatgcgcgcaagcagcagctactgctgggcgaggagcgtccgccggcactgttcacctggaacagcgacggcagccagaccctcaagggtgacaagcagaaactggaaagcgatgagctggatctgcgcaacctgtctgccctgagcatcgaccctcgcaccggtcataccctggtgctgtccgccgattcgcacatgttgctggagctggacgaaaccggcgagcaggtcagcttcatgaccttgctgggcggtttcaatggcctcaaagacaccattccacgggccgagggcgtggccatggatgagcagggcaacctgtacatggtcagcgaacccaacctgttctatcgctttgagaagcactgattcagaagtttctagcggcaaaaggccataatccggcatacgcccgctgcgattaagtttaaattcatccggccgtgatatttcatccgcctgatttgtatttgagcttgccagcatgcgtcgactcgcctatcccaaaccgctgttcctcctcctgtgttttatcgtgctggtgctgctgggcattgccgggcagcaccaccgctacttcgagcgcctgtggttcaactggcgggtcatgtcgcagccggccaacaccgacgccattggccttgatggctatcgggtgactctcgaagcacaaaagatcgaaggcctggatgacgtctcggcgctgacctacgacccggtgcgcaaaagcctgttcaccgtgaccaacaagaatgccgagctgatcgagctgtcgctcgacgggcgcatcctgcggcgcatcgccctgaccgggtttggcgacccggaagcggtcgagttcatcagcgccgacacctatgtgatcaccgacgagcgccagcagcggctgatcaagatccatctggaggaggacacggtgttcctcgacgcggcggacgccgagcagatgaccctgggtgtgcacatgagcggcaacaagggcttcgagggcctggcctacgattcggtgggcaagcgcctgttcgtcgccaaggaacgcgacccgatgctgatctacgaggtcaagggcttcccgcattacgacccggagaagtcctacgcggtgcatgtggtcaacaaccccaagcgcgatgccgggttgttcgtgcgtgacctgtccagcctgcaatacgacgagcgcaccgggcatctgctggcgctgtcggatgagtcgtggctggtgctggagctggacgtggatggccggcccctgagcaccctgtcgctgcgcaagggccgacaaggcttgcaggccacggtgccgcaggccgaaggcattgccatggacgacgacggcaccctgtacctggtcagcgagccgaacctgttctacgtcttcaagaaacccgccccgtagccgctgccgagcccgcgaggctgcgcccgggcgcgcagcggccgcaaaccagacaaccccagcctcccagaccgtccgcataccccgaacctgcgaggactgcatcgcaatgccgccacctcgtacgcagcctcgcaggctcgccagcggctaccaaagcgtgttcaaaactgccactgcacgccgagggaatagccggtctggctgccttcggcatgaccgagccggccgttgacctcggcgtacagccccaactgcggggtgatcgccagctggctgccgagctgggcgcggccgaagctcttgtccacgccgcccaggcgagccacgcgcacttgaccatcggcgcggctggtcaggtccaggtcgtccaggcggccatccgccaactccttgacccaggccaggtcgccataaggcagcaagctcatgccgtaaggcagggccacggcaccgcgaacacgccagccgaggctggcttccagcgaatcgaatgactgctcctcataactcagcgccgtgcgcaggtcctgcttctcgtggaagcggtcgatgcggtagtgggtgtaatccaggccggcgaaggggccgctcttgatcgcaccgaagtcgaagtcgtaaccgccgagcacgcgggcgcccagggtcagggcggcggtatcgcccgtcagtttctggttcagcagtaccgggccgccgttggcctggatcaccaggttgcgcttggactcgaaacgggtgcgaccgacgctcagatcgccggccagccattgcgggccgccatcgttgagcaaggcgtagaccgccgcctgccaggtgtcgctgtcgagcttgccgcggtgctcaagcttgtcgcgaccgttctggtagctgaggctggcgccgacattcaggctcgaattgagctggtagtcgcccaaggcatgcacccccagccgacgcgcctcgggattgggcgcgctgtcgaaaccgctgtcggggctgtattcgccgtcgatgccgatctcgccatcgaaactgccgacttcccggcccatcgcctgcaaggtcagccagcgccggtcgtgcagccggaccatggcctgatgctggcgttgcagatgatcctgctggttgcgcgccacggcgccgccggaagcggtggaggccagcaggtcggcattggtcagctccaggaccaggcggctgagcaggcgcgagtaatcgcgcaggcgctggtcgatgcgttcctggccgaaggcgttggtcagcaccgccttattgtcctcggcgggatcgtgccaggtggagccgccggggatggccgggttggtggtctgggtgtagccgtccaggtcgccgatttcccagtgggtggcctcgatgtagagaatcgggatgttcagcccttcgaaggcttcgccgtcgctgcagcagccggtgcccgcggggtatgccgggtcgaggccggggttggtgagcagattgatctgcagttccctggcgatccgcagggtatgttcgcgcaacgaggccagggccgggttggcgctgctgttctgtccggcgtgggcatacatcatgtcgccggtgatcaggctgtcgaggttgatcatggccagcatgttggcgcgctgattggcgctgagggcgtcgacgaacgccctggagccgcgcaggccttcttcctcggcgccgaagccgaccacctgcaagccgttttccagctgcagcccgccgaggtccaggaaaagtcctggcggctgatgccgtaggcactgcccatctggctctgcatccagtcggcggcaccggcgaagttggcggtgccacggtagcggccggggtagtcgttgatcagtttgtcgaaggtggtggcggcgtgttcgccgtattcataggcgaaggcctgggtggacagcaggacgctggcgagactgacggcaagcgtgaggggcttgagcacggtgatcttccttgagggatgaaaaaaacgggggcagttgcacaatgcgcgcctcattccttgggcgaccttgtattggcgcattgcttaaaccgaacgtcgcctggcgctaatttgtaacggatttgataccggaagtcctgggccgcaccgagacctggtgcgcgaatccggatatttctgcggctaaatgcagcgaaaagtagcagtagtggcgaggttggtgcgggagggcagggcgggggctggatgggagagctttcgcccccgcccttgcggcaggggcgaaatcagcggcatcaggcggtgagggtcttcacgccttcgcgggtgcccagcagcagcacgtcggccgggcgggcggcgaacaggccgttggtgaccacgccgacaatcgcgttgatctgcgcttccagctccaccgggttggtgatctgcatgttgtgcacatcgaggatgatgttgccgttgtcggtgatcacgccttcgcggtagaccgggtcgccaccgagcttcaccagctcgcgggccacgtggctgcgggccatggggatcacttccaccggcagcgggaaggcgcccagcaccggcaccagcttgctggcgtcggcgatgcagataaaggtcttggctaccgccgcgacgattttctcgcgggtcagggccgcgccgccgcccttgatcagattcaggtgttcgtcgctttcgtcggcgccgtcgatgtagaactccaggtcgctgacggtgttcagttcgtacaccgggatgccgtggcccttaaggcgcgccgcggtggcttcggagctggcgaccgcgccgtcgaaggcggccttgtgctgggccagggcgtcgatgaagcaattggcggtggagccggtgccgaccccgacgatgctcttgtcatcgagtttcgggaggatgaggtcgacggcagcctgggccacggcctgtttgagttgatcctgggtcatgcgggctccggaagcgggcaaggggggaacggaaaggccggcattataggccggtgtcctgagcaggtcattgcccgtttggcgaaccgcttttggtagccgctgccgaaggctgcgatcgaccgtcaggtcgtgacagacgcgagtggccggaggacctgcagacctatcgcagcctccggcagcggctacggggcttttaaaacctctggattcgtgtggtcgcccgggtaaacgctgggttagactcgctggccctgcccaacccgctcagtgatgctttccgatgctcgaacagtacgtcaaaaagatcctcacctcgcgcgtttacgacgttgccgtagaaaccccgttgcagactgcccgccagctctccgagcggctgggcaatcagatctggctcaagcgcgaagacttgcagccagtgttctcgttcaagattcgcggcgcctacaacaagctgacccagctcagcgatgccgagcgcgcccggggcgtggtcaccgcctcggccggcaaccatgcccagggcctggccctggcggccaaggtgctgggggtgaaggcgaccatcgtgatgcccaagaccaccccggagatcaaagtcgaaggtgtgcgctcgcgcggcggcaaagtggtgctgcacggcgatactttcccggaagccctggcctactcgctgaagctggtggacgaaaaaggctacgtctatatccacccgtacgacgatccgcacaccattgccgggcagggcaccgtggcgatggaaatcctgcgccagcatccggggcgcctggacgcgatcttcgtgccggtcggcggtggcggcctgatcgccgggatcgcggcctacgtcaaatacctgcggccggaaatcaagatcatcggcgtcgagccggacgactccaactgcctgcaagcggcgatggccgccggcgaacgcgtggtactgccgaccgtgggcatcttcgccgacggtgtcgcggtggcgcagatcggccagcacaccttcgacatctgcaaggactacgtggatgaagtgatcaccgtcagcaccgacgagatctgcgcggcgatcaaggacatctacgacgacacccgctccatcaccgagccggctggcgccctgggcgtggccgggatcaagaaatacgtcgagcagcgtggcgtcagcgggcagaccctggtggccatcgactccggcgccaacgtcaacttcgaccgcctgcgccatgtcgccgagcgcgccgaactgggcgagggccgcgaggccatcatcgccgtgacgatcccggagaaaccgggcagcttcaaggccttctgcgaagccatcggcaagcgccagatcaccgaattcaactaccgctacaacaccggcagcgaagcgcacatcttcgtgggcgtgcagacccacccggaaaacgatccacgcagcgcgctgatcgccagcctgtccgaacagggcttcccggtgaccgacctgaccgacaacgaactggccaagctgcatatccgtcatatggtcggtggccatgccgcgcgggtcagcgatgaagtggtgttccgcttcgagttcccggaacgcccgggcgcgctgttcaacttcctcaataagctcggcgggcgctggaacatctcgatgttccactaccgcaaccatggcgcggccgatggccgggtggtcgccggcctgcaagtgccggcgagcgaacgccacctggtaccggcggcgctggcgcagatcggttacccgtactgggacgagagtgacaacccggcgtatcagctgttcctcggctgaacggctacgctggtgggcaaggcctcaaggagttaatgacatggaaacgctgaccgtcctcaaaaccgtccatatcctggccaccgtgttgctgctgggcagcgcgctggggctggcgatctgggtctggcgcgctcgtagcaagggtgacgcaagcatctacagccggctgttgcgccggccgctggtgttcgtctggctgttgctggtgatctgcctggccagcttgccgttcagcggctggtggctggtgcatctgctgggctggtcgctgggtcagacctggatcctggcctccagcctgatctacaccgtgggtgccctgagctgtttctggctgcttgcgcggctcaatcggctgcggatcgcttcgggtgtggggagtccgaagttcaccctggcgctggcggtgttcagcttcgtgtgtttcttcgccattgccgggttgatgggcgccaagccggtttgacggcctgatcgcgagcttgctcctataggggcgagctcgcgctagctttctcagtcgcgcaggctgatcaccggccagccacgctgctgggccagggcccgcaggttcgggtccgggtccacggcgatcgggttcgccaccagatccagcaacggcaagtcattcatcgaatcgctatagaagtagctgtcttccaggctatggccggtttcctcgagccagcgcgtcaggcgggtgaccttgccttcgcgaaagcacgggacgtcggtgctgcgaccggtgtagcggccatcctgcatctcgcactcggtggcgatcagggtttccacgcccaggcgctcggcgatcggcgcggtgacgaagcggttggtggcggtgatgatcaccagcttgtcgccggcggccttgtgcttggccagcagttgcgcggccttgggcagcagcagcggctcgatgcagtcgcgcatgtagtcgcggtgccattggtcgagcacgtccatctcggtgcggccgagaacctccaggcagaagttcaggtaggcggcattgtcgagcttgccggccaggtagtcctggtagaactcgtcgttgcgggccttgtaggtgacggcgtcgaggaagcctcgttcgcacaggtagtcgccccaggcgtggtcactgtcgccgcccagaagggtgttgtccaagtcgaataaagccaggcgcatcacggttactcgctgataagtctgaaaaaaggcgatcagaatacggtcttttcacaagagtgcacataaggtaggaagcctcgttgctgctttcacaacctttgtggaacaatgcggcgacatgcgtttgcgaggttgttgccgtgatcgaccccgatggtttccgccccaatgtcgggatcattctgacgaatgatgccggccaggtgctatgggctcgccgtatcaatcaagatgcctggcagtttccgcaaggggggatcaaccccgaagagacgccggaagacgctttgtaccgcgagttgaacgaagaagtaggcctggaacgcgaagatgtgcaaattctcgcctgcacccggggctggttgcgctatcgtttgccgcaacgcctggtccgtacccacagccaaccgctgtgcatcggccagaaacagaaatggtttctcctgcgcctgatctccaacgagcagcgggtgcggatggatttgaccggtaaaccggagttcgatggctggcgctgggtcagttattggtatccgttgggccaggtggtgacattcaagcgcgaggtttaccgccgcgctctcaaagagcttgccccgcgccttctagcgcgcgactgacgacggagttcgaccccgagccatgctcaatacgctgcgcaagatcgtccaggaagttaactccgccaaggatctcaaggcggcgttggggattattgtgttgcgcgtcaaagaggccatgggcagccaggtctgctcggtctatctgctggatccggagaccaaccgttttgtcctgatggccaccgagggcttgaacaagcgctcgatcggcaaggtcagcatggcacccaacgaaggtctggtcggcctggtcggtacgcgcgaagaaccgctgaacctcgaaaacgccgccgatcacccgcgttatcgctacttcgccgagaccggcgaggagcgttatgcctccttcctaggtgcgccgatcattcaccaccgccgggtcgtcggcgtcctggtcatccagcaaaaggagcgtcgtcagttcgacgagggcgaagaagccttcctggtgaccatgagcgcgcagctggcgggggttatcgcccacgccgaagccaccggttcgatccgtggcctgggccgccagggcaagggcatccaggaagccaagttcgtcggcgtgcccggctcgcctggcgcggcggtcggtaccgcggtggtcatgctgccgccggccgacctggacgtggtgcctgacaagagcattaccgacatcgacgccgagctggcgttgttcaagaccgccatcgaaggcgtgcgcgccgacatgcgcaccctctcggaaaaactcgccacccagctgcgtcccgaagagcgggcgctgttcgacgtctacctgatgatgctcgacgatgcctctctgggcagcgaagtgaccaccgtgatcaagaccggccaatgggcccagggcgcgttgcgccaggtggtcaccgatcacgtcaaccgtttcgaactgatggacgatgcctacctgcgcgagcgggcgtcggacgtcaaggacctgggccggcgcctgttggcctacctgcaggaagagcgccagcagaccctggtctaccccgacaacaccatcctggtcagcgaagaactgacgccggccatgctcggcgaggtgcccgaaggcaagctggtcggcctggtctcggtattgggttcgggcaactcccacgtggcgatcctggcccgggccatgggcattccgacggtgatgggcctggtcgacctgccgtactcgaaagtcgacggcatccagatgatcgtcgacggctaccacggcgaggtctacaccaaccccagcgacgtgctgcgcaagcagttcgccgatgtggtcgaggaagagcggcaactggcccagggcctggatgcactgcgcgacctgccatgcgtgacgctggacggccaccgcatgccgctttgggtcaacaccggcctgctggcggacgtggcgcgggcgcagaagcgtggcgcggaaggcgtgggcctgtaccgcaccgaagtgccgttcatgatcaaccaacgcttcccgagcgaaaaggagcagctggcgatttatcgcgagcaactcgcggccttccacccgcaaccggtgacgatgcgcagcctggacattggcggcgacaagtcactgtcgtatttcccgatcaaggaagacaaccccttcctcggctggcgcggcattcgcgtcaccctcgaccatcccgagattttcctcgtccagacccgcgccatgctcaaggccagcgaaggcctgaacaacctgcgcatcctcctgccgatgatttccggcacccatgagctggaagaagcgttgcacctgatccaccgcgcctggggcgaagtacgcgacgaaggcaccgacgtgccgatgccgccgatcggggtgatgatcgagatcccggccgcggtgtaccagaccaaggagctggcgcgccaggtggacttcctgtcggtcggctccaacgacctgacccagtacctgctggccgtggaccgtaacaacccacgggtggcggacctctacgactacctgcatccggcggtgctgcaagccttgcagaccgtggtgcgcgacgcccatgccgaaggcaagccggtgagtatctgcggcgagatggccggcgatccggcggcggcggtgctgttgatggcgatgggcttcgacagcctgtcgatgaacgccaccaacctgccgaaagtgaagtggatgctgcgtcagatcaatctcagcaaggccagggaactgctggccgaactgatgaccatcgacaatccgcaagttatccacagctcgctgcaactggcgctgaagaacctgggcttggcgcggatgatcaatccggcgtcggccaagaccctttaatcctctgttgtttccattgcaagcaagcccgctcctacagctgcaggagcgggcttgcttgcaatagcgtccgctaaatcctcagctccacctcccccagatgcccgccatagggcccgaagctgcgctcgactatgtgcctggaaccatcggcccggacgatcagcgccgtgctggcccgcgtgccgtagctagggctggcgataaacacgctcgacagcaggctctcggtggccaggccgaccccggtatcgggaaggtcggcaaacggcgcggtctgcgcatcgctgagcagggcgagcagagcctggggctgcgggtcgtccagtacttcctgtaatgctgccttggccttgagcagcttgggccagggcgtgtcgaggccggcattcgacaggccgtacacgccactgcccagttgctgcggctcacgggcctgggcgttgtagtgccagagctgatcgggggtacccaccagcaggttgaagccggcatattccagcgatcggccgacaacgtcgctgaaatagtcgtctatcgacatcttgctgctgagaaaacgcgctaccagttcacctctggagcggcgcgcggggggctgatggggattgcggatattggtcagggcggcgaagcgtccgtcggcgcccaggccgagccaggtgccgcccgcttccaggtcgcgtccggcatagatatcgggggcttcgggccattgcgccaacggcaggctggggcgggcgtagaactcgtcacggttggccgcgacgatcaggggcagggcgtggcccggccgccaggcgaatacgatcaagcacatcaggttgtcccttttgtgttttttgctcactttacgcacagaacgactgggtatccatcgccatccagtggagccaagggccgtgcatccgttaccatgccgctctcttttcggggtgcctccatggaatttctgctctatctgctgctgggggcctgcgcgggcatattggccggtctgtttggcgtaggtggcggcatcatcatcgttcccgtgctggtgttcagcttcaccctgcaaggtttcgatccgtcgatcctgacccacctggccgttggcacgtcgctggcgaccatcatttttacctcggtcaacgcggttcgcgaacaccagcgcaggggcgcggtgcgctggccgatctttgcctggatgaccctgggcatcctgctcggcgccggagtcggggcgctgacggccgaagcgatttccgggccgaacctgcagaaaatcatcggcatcttcgccctggtggtcgccctgcagatgaccctggacctgcggcccaaggccagccgcgacgttcccggcaagctggggctgaccctggccggcagtgtgatcggctgggcctcggcgattttcggcatcggcggcggctcgctgaccgtgccgttcctgacctggcgcagtgtgccgatgcagcaggcggtggccacgtcctcggcctgcggtttgccgattgccgtggccagtgcaataagtttcatgattctgggctggcatgatccgttgctgccggctcatagtctgggttttgtgtatttgccggcgctgctgggcatcgccctgaccagcatggtctttgcccggttcggcgcgcgcctggcccatcggctgtcggcgcgcctgttgaagcgcttgttcgccggcctgctgtttgtggtcgggttgacgttcctgctctgacaggttccgcaatcctggcttaatccgcgcgtgacatggtcgcggcgcaatcgagtttcactctaacgaggagtcgcaatgctgccttacccgcagatcgacccggtggccctggccatcggtccgctgaaaattcactggtacggcctgatgtacctgatcggcatcggtggcgcctggctgctggcgtcgcgccgcttgaaccgcttcgacccgacctggaccaaggagaagctctccgacatggtgttctggatgtcgatgggggtcattgtcggcgggcgcctgggctatgtgctgttctacgacctgagcgcctacctggccaacccgacgctgatcttcgaggtctggaaaggcggcatgtcgttccacggcggtttcatcggggtgatgctcgcggccttgtggttcggcaagaagaacggcaagtcgttcttccagctgatggacttcgtcgcgccaatggtgccgatcggcctgggcgccgggcgcatcggcaacttcatcaacgccgagctgtggggcaagccgaccgacctgccgtgggcgatgatcttcccgccgttcagcgacccggcccagctgccgcgccatccttcgcagctgtatcagttcgccctggaaggcgtggcgctgttcctcatcctctggctgttctcgcgcaaaccccgtccaaccatggcggtttccgggatgttcgccctgttttacggtattttccgttttatcgtcgagttcgtccgggtcccggatgcgcagttgggctatctggcgtggaactggctgaccatgggccaggtgctgtgcctgccgatgatcgttggcggcctgttcctgatctggctggcctatcaccgcgctccagcggcaccggtggcgaaagacgccgcgctttaaattcggatcgcagggcgcgagccctgccttcaaggacacaggtaatacatgaagcaatatctcgatctggtcgcccacgtcatcaagaacggcaccaagcaggccaaccgcacgggcgtgaacaccatcagcttccctggcgcgatgctgcgttacgacctgaaagacggttttccggcgatcaccacccgcaagatggccttcaagtcggccatcggcgagatgtgcggtttcctccgtggggtgaacaacgccgccgaattccgtgccctgggctgcaaggtgtgggaccagaacgccaacgaaaatgcccagtggctggccaaccccttccgcgagggcgaggacgacctgggtgagatctacggcgtgcaatggcgcaagtggccggcgtacaagcagatccccctgagcaacccggccgccatcgagcagaccctgaaccagggctaccggcagatcgccgaaggcgaggaagacggccaggcctatgtggtgctgtacaaggccatcgaccaggtgcgccagtgcgtggacaccatcatcaacgacccgggcagccgccgcatcctgttccacggctggaactgcgcccagctggatgaaatggccctgccgccgtgccacctgctgtaccagttccacccgaatgtcgagacccgggagatttccctgaccctctacatccgttccaacgacctgggcctgggcacgccgttcaacctcaccgagggcgccgcgctgctgagcctgatcggtcgcctgaccggctacaccccgcgctggttcacctatttcatcggcgacgcccacgtctatgaaaaccacctggacatgctcaacgaacagctcaagcgcgagccgttcccgatgcccaggctggtgatttccgagcgtgtgccggagttcgccaagaccggcgtatacgagccgcagtggctggaaaaggtcgagccgagcgacttctcgctggaaggctacgagcaccacgcgccgatgaccgcgccgatggcggtctgagcgagatacccggcggcggctcctgtagccgctgccgcaggctgcgataaggcccgcagggcctcttctagcaatcccgaagaccacgcccacacgtggtcgatacggcatctgcctctgtgtaggagcgagtttggcccgcgtcgtttctagtggccgtggctacggcccacatgagagtcctcggcttcgctgggcgccaccgagccgctgacttccaggcgctgcaaaatcccgcactgatccaggtccggcccttcgctgcagcgttggcgcaggtcgagcagctgtgtctgcaaggccagcagcccgtcgatccgcgccttgacgtggtggatatgttcgtcgatcagcgcgttcacgttctggcactggtcctgcgggctgtcgcgcaggttcagcaggctgcggatttcctcgagggtcatgtccaggctgcggcagttgcgaatgaaggtcaggcgttcggtgtgggcctgggtatacagacggtaattgccctcgctgcgggccggttccggcagcaagccttcgcgctcgtagtaacggatggtttcgacctgacagtcggtcagtttcgccagctcgccaattttcatcgcgacaatctccgaaagggtgcttgaccctatagtggctacagggtgttcacttggcaacaggcaccttttcggacgcgaccttatgagcgattccctgcacacccacggcaagcccggcgctgactccaagcatgctggccacgatcacgatcacgatcacgatcacggccatggcaccaaactgcatccgctgaaagaacacgaccatgctggccacggcgcttcctgctgctcgtcgccgtcgctggtccagttgagcgagccccaggccgccagccatggcgattcctgctgttcgtcggccgccgcgccgtcgcgggttgtgctcagcgcggcgtcgagcgccaatgcgcgcctgagcagcttccgcatcgaggccatggactgcccgaccgagcagacgctgatccagaacaagctgggcaagctggcgggtgtgcagcaactggagttcaacctgatcaaccgggtgctgggcgtgacccacgacctgcaagacgtcgccccgatcatcgctgccatcaagtccctgggcatggaagccgagcccatcggcctgggcggcgagtccgatgccccggccgcggtgccggtgaaaaagcactggtggccgctggcgctgtccggcatcggcgcgctggccgcggaagtgatccacttcaccagcgccgcgccgacctgggtggtggcggtgatcgccctggtatcgatcctcagtggtggcctcggcacttacaagaagggctggatcgccctgaagaaccgcaacctcaacatcaacgccttgatgagcatcgccgtgaccggcgcggtgctgatcggccaatggccggaagcggcgatggtgatgttcctgttcaccgtggccgagttgatcgaggcccggtccctggaccgcgcgcgcaatgccatcagtggcctgatgcagatgaccccggaacgggtcacggtgcaggaggcagacggcagttgggtcgaacgggaagcgaaaagcatcgagctgggcgcgctggtacgggttcgcccaggtgaacgcattggcctcgacggcgaggtggtggccggcagctcgaccatcaaccaggcaccgatcaccggcgaaagcctgccggtggaaaagaccctgggcgacaaggtcttcgccggcaccatcaaccaggccggctcgctggagtacaaggtgactgcggcggccaacaactcgaccctggcgcggatcatccatgccgtggaacaagcccagggcgcgcgcgcgccgacccagcgcttcgtcgacagcttttcgaaaatctacacccccgcggtgtttgccttcgccctggccgtggcggtgattccaccgctgttcatgggcgccgcctggttcgattggatctaccgcgccctggtgctgctggtggtggcgtgcccctgcgcgctggtgatttccactccggtgaccatcgtcagcggcctggccgcggcggcgcgcaaaggcatcctgatcaagggcggggtttacctggagggcggttacaagctcgactacctggcgctggacaagaccggcaccatcacccacggcaagccggtgcagaccgatttcctgtccctagacccgctggcggacaacagcgccccggccatcgccgccagcctggcgtcccgttccgaccacccggtgtccctggccatcgccaatgtggctgtggataagcagctgagcctgcaccttgtggataacttccaagccctggccggccgcggtgtgcgtggcgaaatcaacggccagctctaccacctgggcaatcaccgcctggtggaggaactggggctgtgctcgccggagctggaagagaagctgttcgccctggagaaacagggcaagaccgtggtgctgttgctcgacagcgtcggccccctggccctgttcgccgtggcggacacggtcaaggagtccagccgcgaagcgatccggcagttgcacgagctgggcatcaagaccctgatgctgaccggcgacaacccgcacaccgccgaagccatcgccgcccaggtgggcatcgatcaggcccgcggcgacctgctgcccactgacaagctgcaagccatcgaagacctgtacgcccaagggcaccgggtcggcatggtcggcgacggcatcaacgacaccccggccctggcccgcgcggagatcggtttcgccatggccgcggcaggcaccgacactgccatcgagaccgccgatgtcgccttgatggacgacgatctgcgcaagattccggcctttgtccggctgtcccgccagacctcgaacatcctcgtgcaaaatatcgccctggccctggtcatcaaggcgatctttcttggggtaaccttcttcgggttggccaccatgtggatggccgtgttcgccgacatgggcgtcagcctgttggtggtcttcaacggtttgcgcctgttgcgcaaatagacgatgagaggacgcagtgctgagtgccgagctgaaggcgttttacctggtggcccgcctgggcagcatcaccctggcggcgaaaaagctcggcctgagccaaccgacggtgaccacccagatccgtcatctggaaagccagtatgcggtcgagctgttctaccgcggcggccgccgcctcagtgtcagcgaagagggcgcccggctgctgccgatggtcaaggcgctgttgcaacaggaagccgatatcgagtttttcctgcgcaatagcggccagctgcaaggcaccctgcggattgccgccacggcgccgtattacatcctcgatctggtgaagaccttccgggagcgcctgccccaggtggaagtgtcggtggaaatcggcaactcgcagcaggtcctggaatcgctggaggagtaccgggtcgacatcgccgcgtcctcgcagctgctggaagattcgcgcttgatccgccgggtgctcggcagcgacccgctggtgctggcggtgcaccgcaatcatccgttggcggccctcgatcatgtgcccttgaacgccctggccgggcataccctgctgatgcgcgagccgggctccaccacccggcgcctgaccgaggaattgctcgacagcgcccgggtcagcttcgggccgctgctggagatcggcagccgcgaatcgatccgcgaggcggtgctgcgcaatatcggcatcagcatcattgcccgccaggaagtcccgcacgatccgcagctgcgggtgctgaccatcgagaacgcgccgcagatcgccgaatacctgtactgcctcaaggagcgcaaaggcgcgcgcctgccggcggccttcctcgggttggcgcaggaaatggcgccggcctgaaccctgctccttgtagccgctgccgagcgcagcgaggctgcgaactggtgcgcagcgcccgcaaaaggcgccctgcggttacctcgccagatcgcgttgtcggacctgcggttgctgcgcaaccgttcgcagcctcgcgggctcggcagcggctacaaggctctgcgttctcttgaacccaaatccgccaataccactatcggcagcttttgcctcactgccacagtaactacgcattcgccccctaggatggcctgcatctgcttgatgaggtccgtccatgaaccacccgatcgcaactgccctgagcaaccccggcgcaccgatgaaagtgcgcggcatgcagaaacgctttggcgctttcaccgccctggataacgtctccctggacgtggcggccggcgagctggtgtgcctgctcggcccgtcgggctgcggcaagaccaccttgctgcgttgcatcgccggcctcgaacgccaggaccggggcgagttgtacctgggcagccgcgatgtttcgcacctggcgccccaggcccgggactacggcattttgttccagtcctatgcgctgttccccaacctcagcgtcgaagccaacattgcctatggcctggccggcagcggccgcgacgaagtgcgccagcgcgtggcgcagatgctggaactggtgggcctgaccggcagcgaaaagaaatatcccggccagctgtcgggcggccagcagcagcgggtggccctggcgcgcgccctggccccggcgccttcgttgttgttgctggatgaaccgatgtcggcgctggatgcccgggtgcgcgagcacctgtgcaccgaactgcgccagctgcagcggcgcctggggatcaccaccctgatggtcacccataaccaggacgaggccatgttgatggccgaccgcatcgcggtgatgaacaacggcaaggtcgagcagtacgccacgccgcaggaaatctacgatcgcccggccaccccgttcgttgccgaattcgtcggccagggcaactggctgccgttccgccgcagcagcgacagccacgcccaggtcggcgggatgaatgtgcggctggcggccgactccggcaaggccgcctcgggccgcttgttctgccgcccggaggcgatcagcgtcaacccgccggtgcacgaggaaaacctgttcccggccaaggtccgggagatcaccttcctcggcaaccgctgccgcatgagtttcgaactcaaccaattgcccggccatccgctgctggccgaactcgccccggaagccatgccgcgcctcggtgcccaagacatctgggtcgccttgccaccgcgcagcctgcaggtgtttgcctgagatggccgttgaactgaccctgccgctacccgcgaaacgggcgcgccaggcggcccgtgcgcaaatcggcgaccgtatcttcgtgctcggcggcaagctggtcctgctggtgctgctgggcctggcggtgttgctgccgttgctggcgatcttctggcgcggtttcagcggcgaagccgggcagggcggcggcctggtcgccgcccgtgagctggtgaccagcgccaacttccactggctgttgggcaacagcctgaaagtctccctcagcgtcgccgccatcgtggtgccgctggcctacctgttcgcctatgccctgcaacgcacgctgattcccggcaaggcgatctggcgcggcctgtcgttgctgccgctgatggcgccgtcgatgctgccagggatcgccctggtctatctgttcggcaaccagggcctgctccgtggcctgctctcggacaatatctacggcttctggggcatcgtcctcggcgaggtgatctacacctttccccacgcgctgatgatcctgctgtcggccctgtccctggccgatgcgcggctgttcgacgccgcgtcgagcatgggcgccagcccggccagggcctttggcagcatcacctggccggccacccggcaggcggtgttcgccgcgttctgcctggtgttcaccctgaccatcaccgatttcggcgtgccggtggtggtcggtggcgactatcaggtcctggcactggaagcctacaaggcggtggtcggccagcaacagttcggccgtggcgccttgatcggcatggtgctgttgctgccggcgctgttcagcttcggcgtcgatgcctggctgcgccgtcgccatggcgactccatgagcggccgggcccaggtgttccagccggcgccttcccggctgcgggacggctgctacctggcgatcgtcctgctgatctgcgcggcgctgctgctggtgttcggcatggcggtgttctcgtcgctggtgaagttctggccctataacctttcgctgtcgctcaaccactaccagttcaacgacaccgccggcggcggctggctggcctaccgcaacagcctgaccatggccctgtgcacggcgctgatcggcagcgcgctgatcttcaccggcgcctacctgatggagaagacccacgccctgcgcggcctcaacctggcgctgcgcatcctcagcttcgtgccgatggcggtgccgggcctggtgctgggcctgggttacgtcttcttcttcaacctcagcggcaacccgctgcatgtgttctacggcagcatgaccctgctggtggtgtgcaccattgctcactacctgaccaccgcgcagatgaccgccaccaccgcgctgcgccagctcgacgccgaattcgaggccgccgcgctgtcgctcaaggcgccgctgtatcgccattacctgcgggtcaccgtgccgatctgcctgccggcgctgctggacatcctgcgctacctgttcgtctcggccatgaccaccgtctcggcggcgatcttcctctacagccccgacaccatcctcgcggcggtggcggtgctgaacatggacgacgctggcaacgtcggcggcgcggccgcgatgtcgaccctgatcctctttacctcggcgggcgtgtccctgctcctggcctgggcttcgcgcggtttgctgcgccgctcccaggcctggcggcagaccgcgcccggtcactgaatctgcccaacccccactaacaagcccccactccagaaaggaaccgcaccatgttcaagcccctggctgttgccgctgctgtcctcactgccttcagcatgaacgcctttgccgcgaagaccgaactgacggtctataccgccctcgaagccgaacagctcaagagctacaagcaagccttcgaagccgccaacccggatgtggaaatcaaatgggtgcgcgattccaccgggatcatcaccgccaagctgctggcggaaaaagcccggccgcaggcggacgcggtgtggggcctggccgcttccagcctggcgatcctcgatcagcagggcatgctgcaaagctatgcgccgaaggacctgggcaagatcggcggcaactaccgcgacgccgccagcccgccggcctgggtcggcatggacgtctgggccgcgaccatctgcttcaacaccgtcgaggccgaaaaacagggcctgaccaagccggtgagctggcaggacctgaccaagcctgagtacaagggcaagatcgtcatgcccaacccggcctcgtccggcaccggcttcctcgacgtcagcgcctggttgcagaccttcggcgagaagcagggctggcagtacatggacgagctgcaccagaacatcggccagtacgttcactccggctccaagccgtgcaagctggcggcggctggcgaattcccgatcggcatctccttcgaatacccggccgtacagctcaagcgccagggcgcgccgctggacatcgtgctgcccaaggaaggcctgggctgggaaatcgaagccaccgcggtgatcaagggcacccctcatgaagacgcggcgaagaagctcgccgacttctctgccagccccgcggccatggagctgtacaaggaaaacttcgccgtcctggcccagccggggatcgccaagccgcagaccgaactgccggccgactacgagcagcgcctgatcaagaacgacttcgcctgggcctcgaagaatcgcgaccagatcctcgccgagtggcgcaagcgttatgacggcaagtccgagaaggtcgccgcccagtaaccaatagaccgttatcgcgagcaatcgagcgtcgaccggctgctcctacagggttggcctttgtaggagcgagcttgctcgcgattgacctcgtagggtcatttcccaaggaccacacccatgagcaaccacaacgacctgctgatcgtcggcgccggcattctcgggctgtcccatgcctatgccgcggccaagcgcggtttgcgggtcaaggttttcgagcgcagcgccacgcccctgggcgcgtcggtgcgtaatttcggccaggccctggtgaccggccagccgccgggcgtgatgctcgacctggccagggctagccgtggcatctggggcgactgggcgcagttggccggcctgccgctcaagcgcaacggttcttacctgttcgcccgcaccgaggccgaggagcaattgctgcaggccttctgcgccggacgcgcgcgggaacacggctaccgcgtcgaactgctgcgcggcgcggcgttgaacgatctgtacggcggccgcttccgccatcatcgcgcggcgctgcatggcctggatgaccagcagctgtattcccgcgaagccatgccgatgctgatcgactacctgcgccgcgacctgggggtggagtttcatttctccaccctggtgcgcgacatcgagcccggccaattgcacagcaccgccggcagctttcgcgcggggcagatcctggtctgttccgggcatgactaccagaccctgctggccgagccgattgccgcgctggcgccgcaggtctgccgcctgcaaatgctccgcgcccggcccgaggtgcagctggacctgcaacacgcgctgctcaccggcttgagctgcgtgcattacggcgcctttgccgacctgcccgaagcggcggcggtgcaggcgcagatcctgcgggacgcgccacacctgcacgaaaacggcatccacctgctgatcagcccgacgccctatggcgagctgatcatcggcgactcccaccattacggcagcgacccgtcgccgttcaatgccgagcaggtggacacctggatgctcgaactggccgaacacaccctgggctgcaaggtgcgggtggtcgagcgctggcagggtgtctatggcgcccgcggcccggggccgttttcgttcctgcgcccggccgccggggtcagcgtggccctgatgcataccggcgtgggcatgagcgtcggcccggccatggccgagggcaatatcgcccgcttgctggagcaagcctgatggggcctgagcagcggatcgccgaggtgttcggcctgtacgagcgctttggcgacagcgactacatcggcgagccggtgtcgcagatcgagcacatgtcccaggccgcgcaactggccatggccgagggcttcgacgacgaagtggtactggcggcgttcttccacgatatcgggcatatctgcgcgcaaggtgtcgagagcatgggcggtttcggcatggccggccatgagcggctgggcgccgactacctgcgccgcgccggtttcagcgagcgcctggcgcggctggtggagtaccacgtgcaggccaagcgttacctgacctgcaaggagccgggctactacgagcggctcagccaagccagccggcgcaccctggaataccagggcggggtgatgagcgccgaagaggcccgagccttcgagcaggacccgctatgcgcggtcagcctgcgcctgcgccattgggacgaacaggccaaggagctgcgggtgccggtgatggatttgcaggtgctcaaggacaaggcggtgcggttgctggcggcctgatccgagtcctgcggtgcccgggggacagctatcgcgagcaagctcgctcctacaggggaacgcatgttctgtaggagcgagcttgctcgcgatgacgtaggcgggggcgccgcaggcttaactgtcgaccaccagcttctgcgccaacacctcgatctgctcctgacgttcggcctggctcaggcgcggcgccgggttcagcgacgaccactgcggatgggcgcgggccttgctcagggcttccggcagcttgccctcgcgccagctctggtcctgaggcgtggccagttgaatgctgcccagcgccgcatgcccacgcacattcaacgcttgcaccagttgccgttggcgcagggccaagaggcgcaacacgctgtcgtccacagtcagttcgcgctggcccttgagcttacccagcaggcggccgccgtagctgcgggcggtttgcagcgcgccaccggcaatcgccccggccagggccgccgcgcctagggtcaggccgcccaccagcagatcgacgccagccccggccgccgcgccggcggcgatcccgccaccgacccggaccccgagttgcttgagggtttccgggttgaacagatcatcgccccagcgtccgtcgagcagcggcacatcgctggcggcggcatcctgcgggcggaaggcgtagagcttgagcagcgcctcgacacagcgctgttcgcgctggcgcacggccttgcgcagctcgccgatggcctgttgttcctgctcgacctcgctgaccacactgcgccggcaggcggcgcaatcgatcagcagttcggcgatcagccgcgcggcgctttgctgacgggccaggcgctgcgcctgctggtcggcgatcaggcgttccagctgcggccgcgagctttccagaagcaacgccaggctttcatacagccgccgctcgccatcctccggcggcgccacgctgtcgaaccgcaccagtgcatgcaggcccaggcgggccagggcttcgcgccagtccggctcgcgatggttggcgctgctgacgaagttcagcaccggcagcagcggcttgccgcagctggcgaggacttccagttcgtcgcggtacttggccagtaccggctcgcgagcgtcgatcacatacagcccggcgtcggagtccagcagttggcgcagtaccttggcttcctgttcgaaacgctggcgcgcctcgctgccttcgagaaaccgcgccaggcgggccgggccatccaggcgctcgccggggtgctccaggcgttccaggtagtcgagcagggcgatggcgtcttccaggccgggggtgtcgtacaggtcgagcagcggttcgccgtccaccgacagccgcgcgccctcgacatggcgggtggtactggggcgatgggagacctcgccgaaccccacatcccgggtcagggtgcgcagcagggaggtcttgccgacgttggtgtggccgaccaccgccagcttcaacggtggtttgcgaggatcagtcatgcccgatctccagccagttcagcggtgcgcaatcggcgaatggcagctccagctgttgcagcgccacgtgccagtcgcccaggcgttcggcgtccagcgcttcgccgggcggcgcctgcaacagccagacccgggtggcggtggcgctgcgggccagttcggcgatcagcgccaggctgccacggtccggcgagcgccgtggatcgcaggcgatggccaggcgcgccggcggaaagcggctcatctgctccagcagcttgtgccgggattcgcggctgtcgaggatgccggcgtctttcaccgtggccggcaattgcggtggccaggggcgctggtcgtccagttcgatggccaccagcagggcgccatcgctgtcctgcgcgctgacgccgccttcgacgcggtgcagcagttcgggggcggcatcgttgatccccaggcgttcgctgctgggcatcagcgcttcgcgcagctggctgtagccggggaggttgaggtccagttgcaggcgcgcctgcccgtgcttccagcaccagcgacagaacagcatcaacagcaggcgcggcagcacgccgtaaatgatcagcgaggccaccagccagacggcccacatctggcgcaccagttcagtgttgtaaacatcccgggtgctggcgtgaatcatctctacggtcggtaccccgaaacctatggcacggggtatggccgcgagggcgttggtgatcgccacgaaggcatccgcgccgagcagggtgctttcccagtagaacccgtagcgtttggtgatcagcagcatcagcaggatcgccacggcgctgagcagggccagcagccacaagccgttgatcagggtgccaatggcccagcgattgagtttgcgccgttgcagcaacagcagcagggcgggcgccagctgcgcggccttggcgtcgcgggcgagcttggcgctgagccacagccacaggcggccgaggctggcgccgtgttcaccggcgaacagcaggcccagggcccagctcagcagcagaagcaggttgaggccgagcaggctacccagggcccagaacacgttgaccggcgcctgcccgttacccagggcggcgaaggccaggccggcaccgctgaccatggccaacacggccatcagcaacagggccaggcgcgcgccctggacccagtggcgcagggcagcggccaggccgtcgcgttcggccagccacagcgcgcggtattggaggcggctcgccagatcgccgcccgcggtgcgcgccagacgattggcttcctggtcctccagggcgccggcgtgttcctcgcgcaggcgtacggcttcggtgagccagagtttttgcagtggggtcagtgctgtcacgcgtcattccgttgctcaaatgagcgctgagcataaccgctgtcgcgctgatcggggtacgttgcggggcaccgagcctctggtatcctcgccggcatgaaaaaatctctccctctcagcctgatcgcggccctcggtgaaaaccgcgtgatcggcgtcgacaacagcatgccctggcacttgccgggggatttcaaatacttcaaggccaccaccctgggcaagccgatcatcatgggtcgcaagacctgggattcgctggggcgtccgctgccgggacggctgaatatcgtggtcagtcgccaggccgacctgcggctcgaaggcgccgaggtgtacccgtcgcttgaagccgcggtggcgcgtgccgaggagtgggcgctggaacagggcgttaccgagctgatgctgatcggcggtgcgcagctgtatgcccagggtctggagcaggccgatcgcctgtacctgacgcgcgtggcgctgagcccggagggcgatgcgtggtttccggagttcgacctgaaccagtggaaactggtgtctgacatgtcgaacccggcggaaggcgacaagccggcctacagcttcgaagtctgggaaagggtttaaccccgtagccctgtagccgctgccgagcctgcgaggctgcgatcgaggacgaagtcctcgcaaaacccgaacatgcggtgtttctaggaagaacaggttgtctggtttttacgactgcttcgcagtcgatcgcagcctcgcaggctcggcagcggctacaggtcgcagtcccgttccgggtgtgaacccggagcggggctggaatcaagcctgcgccagctccgcatgctcatcggcatcgagcttttctttatcggtctgctgcatgatctggctggtgatcgcaccggcggtcatcgaaccgctgacgttcagtgcggtacggcccatgtcgatcagcggctccacggaaatcagcagcgccaccagggacaccggcaagcccatggccggcagcacgatcagtgcggcgaacgtggcaccaccgcctaccccggccaccccggccgaactcaaggtcactatcgccaccagggtcgcgatccacagcgggtccagcgggttgatgcccacggtcggggccaccatgaccgccagcatggccgggtacaggccggcgcagccgttctggccgatggtcgcgccgaacgaggcggcgaagctggcgatggactgcggaatgcccaggcggctggtttgtgcctcgatgctcagcgggatgctcgcggcgctggagcggctggtgaaggcgaaggtcagcaccggccagaccttgcggaagaagcgcagcgggttgatcccggccagcgacaccagcaggccgtgaaccacgaacatcaggcccaggccgatgtacgacaccaccacgaaactgccgagcttgatgatgtcctgcaggttggagctggcgaccaccttggtcatcagcgccagcacgccgtaaggggtcagcttcatcaccaggcgtaccaggcgggtgacccaggcttgcagggtgtcgatggcgttgaccactttctggcctttgtcggcgtcgtccttgagcagttgcagggcggcgacaccgaggaaggcggcgaagatcaccacgctaatgatcgaggtcggcttggcccgggccaggtcggcgaaggggttctgcggaatgaacgacagcagcagttgcgggatattcaggtcggcgaccttgcccgcgtaatcgttctggatcacctgcaggcgggccatttcctgggtgccggccaccagcccttcggcggtcaggccgaacaggttggtcagggcgataccgatcagcgcggcgatggcggtagtgaacagcagggtgccgatggtcaggaagctgatcctgcccagggacgatgcgttgtgcaggcgcgccacggcgctgaggatcgaggcgaacaccagcgggatcacgatcatctgcagcaattgcacataaccgttgcccaccaggtcgaaccaaccgatggaggttttcaggacgggattgccggccccgtagatgctgtgcagggcaacaccgaaaaccacgcccagcaccagtgccagcaggaccttcttggccaggctccaggtggtgtgacgggtttgtgccaggcccagcagcaaggcgaggaacaccagcaggttgaggatcagcggcaggttcattaaggctccgataagacttgtgccaatcgcttgtggctgcgattgcgaaccggcaagcctaacagcttgatatctaatgaattaatatcaaaaacgcattgggactgtcgtttttggaataagccgctgacgctcaggcacatgccggtggcggaatcaggacgcgggcggtcgcccacaggcgaggattgtcacagcgatttgttagcgtcgatctctttaaatcagggagaaaacgccgatgaaactcgctccgaaatttctggttgccgcactctgcctgggccttgccggccaggttctcgccaccgacttgcagcactggcccgcggaccaggccaagcaactggacgcgatgatcgcggccaacgccaacaagggtaactacgcggtgttcgacatggacaacaccagttaccgctacgacctggaagagtcgctgctgccgttcatggagaacaagggcctgatcacccgcgagaccctcgacccctccctgaaactgatgccgttcaaggacaccgccgagcacaaggaaagcctgttcagctattactaccgcctctgtgaaatcgacgacatggtttgctacccctgggtggcgcaggtgttctccggtttcaccctcaaggaactcaagggctatgtcgacgaattgatggcctcgggcaagccggtgccggccacctatttcgaaggcgacgtggtcaagaacaccgagatcaatccgccgaaaatcttcaccggccagaaagagctgtacaacaagctgatggagaacggcatcgaggtctacgtgatgactgccgcctccgaggaactggtgcgcatggtcgcgtccgatccgaagtacggctataacgtcaagccgcagaacgtcatcggcgtgaccaccctgctcaaggaccgcaagaccggcgagctgaccaccgcgcgcaagcagatcactgccggcaagtatgacgagaaggccaacctcggcctggaactgaccccttacctgtggaccccggcgacctggatggccggcaagcacgcggcgatcctgacctacatcgacgagtggaaaaaaccggtgctggtgggcggcgacaccccgaccagcgatggctacatgctgttccacggtgtcgacgtggccaagggcggcatccacctgtggatcaaccgcaaggacaagtacatggcccagatcaacggcatgatggccaagcacgccgcggcccaggccaaggaagggctgccggtgacggcggacaagaactgggtgatcgtcaagccggaggacatccagtaaccgcgggttgagcccatcgcgggcaagcctcgcagaggccgatctccagacaaaaaaatgccccgcacttggcggggcattttcattcagcggctggcaatcacagaccgtcgagcatcgccttgttgcgcaccgcgcccttgtcggcgctggtggccagcagggcgtaggccttcagggcagtggtcaccttgcgtgggcgtttttccaccggtttccagcctttcttgtcctgctcgacacggcgcgcggccagttcttcgtcgctgaccaacaggttgatcgagcggttcggaatgtcgatcagcaccttgtcgccgtcctgtaccaggccgatggcgccgccagccgctgcctctggcgaagcgtggccgatggacaggcccgaagtaccgccggagaagcggccgtcggtcagcagggcgcaggctttgcccaggcccttggacttcagataagacgtcgggtacagcatttcctgcatgcccgggccgcctttcggaccttcgtagcgaatgatgacgatgtcgccttccttcacttcgtcggcgaggatgccgcgcaccgcgctgtcctggctttcgaagatcttcgcgttgccttcgaagacgtggatcgactcatcgacgccggcggtcttcaccacgcagccgtccagggcgatgttgccgtacagcacggccaggccgccttctttcgagtaggcgtgctcgacactgcggatgcagccgttttcacggtcgtcgtcgaggctcggccagcgggtcgactggctgaacgcggtctgggtcgggatgccggccgggcctgccttgaagaagtggtgcactgcttcgtcgctggtctgggtgatgtcccacttggcgatggcttcttccatgctgcggctgtgcacggtcggcaggtcggtgtgcagcaggccgccgcgcgccagggagccgagaatgctgaagatgccgccggcgcggtgcacgtcttccatgtggtacttctggatgttcggcgccaccttgcacagttgcggcacgctgcgggacaggcggtcgatgtcgcgcaggtcgaaatcgatctcggcttcctgggcggcggccagcaggtgcaggatggtgttggtcgaaccgcccatggcgatgtcgagcatcatggcgttttcgaacgccttgaagttggcgatgttgcgcggcagcaccgactcgtcgttctcgccgtagtaacgcttgcacagctcgacgatggtgcggccggcctgcaggaacagctgttcgcggtcgctgtgggtggccagggtcgaaccgttgcccggcagggccaggcccagggcttcggtcaggcagttcatcgagttggcggtgaacatgccggagcaggaaccgcaggtcgggcaggcgctgcgctcgtactcggcaaccttctcgtcagaagcgctggagtcggcggcaatcaccatggcgtcgaccaggtcgaggccgtgggcggcgagcttggtcttgccggcctccatcgggccgccggaaacgaagatcaccgggatgttcaggcgcagggcggccatcagcatgccgggggtgatcttgtcgcagttggaaatgcagacgatggcgtcggcgcagtgggcgttgaccatgtactccacggagtcggcgatgatctcgcggctcggcagcgaatacagcatgccgtcgtggcccatggcgatgccgtcatccacggcgatggtgttgaattccttggccacgccaccggcgcgttcgatttcgcgggcgaccagctggcccaggtccttgaggtgcacgtggcccgggacgaactgggtgaaggagttggcaatggcgatgatcggcttcttgaagtcgtcatctttcatccccgtggcgcgccacagtgcgcgggcgccggccatgttgcggccgtgggtggatgttttcgagcggtaatcaggcatggagcactccgggcggctaatcaggtaacaaatggggagtgagcttctattgacctctggaacactcagaaatggccgtgtgtcctgaagctgccgatgacgccgcgggatcgccgcgcgcctcagcctgagctcataaacccgccgggggatgactggcgatgaatctcgcgattctacaccgctggcgccaggaaggaatggtgcgaatgaccggcagtaagaacacgcagccccctgtaggagcgagcttgctcgcgatcagccgccaggctgaaatccggcggcgcctgcaaaatggctatcgcgagcaagctcgctcctacaggtcgatcggggcatcagagccagatggcgtcccatagggggtagtcgccgatgcgccggaccaaaccagcgcgcagcgggttggcgatgatgtagcgggccatggctttcaggtcttcgtcacggcgcagggcccggtcgaaatagcctttctgccagacaggttgcgaactattgcggatgcggttgatagccctggcactacgggatttgctgccttgcatcagttttggcaagtcgccgctgtgcagttcgatcagccagtggaaatggtcgggcattaccacccaggctagcgaggttgctgcgcctgtttgttgggcatgcctgagttcgtcgactacccggcgacccaggtgccagtcgtggaagatcgccgaacggtttcgggtgacagccgtgagcagatagatacggcccgattccgagtagcgaccgaggcgcagacgatgggcatggggagcgttggacattccgttgtcctcttcgatggatggaagagcaacggtaggtgctgtgaagaaggctgtcgtagtgacaatgggactggatgtatctgtaggagcgagcttgctcgcgaaaaaacatcaggtaccgcgatccggcagggcgggcgcgttatcgttgacgtttttcgcgagcaagctggctcctacaggttttgtgacgccttgtgtagcggttagctgttaggcagcaggcggcaggtgatgctcttgatgtagcgggtttccgggatggccgggtgtaccgggtggtccgggccctggccgccgcgttccagcagctggatattgcggtccaggtggcgggcgctggtgagcaggatgttctgcaggtcgtcttcgggcaggtgcatcgagcacgaagcgctgaccaggatgccgtccttgctgagcaggcgcatggcctgttcgttcaggcggcggtaggcgccttcgccgttcttcaggtctttcttgcgtttgatgaaggcgggcgggtcggccacgatcacgtcgaaacgctcttcggcggccttgagctctttcagggcttcgaacacgtcgccttcgatgcaggtgactttctcggcgatgccgttgagcgcggcgttgcgctcgacgccgtcaagggcgaaacccgaggcatcgacgcagaacacttcgctggcaccgaaggcgccggcctgcacgccccagccgccgatgtagctgaacaggtccagcacgcgcttgcccttggcgtaaggcgccaggcgggcgcggttcatgcggtggtcgtagaaccagccggtcttctggccttccatcaccggggcctcgaacttcacgccgttctcttccagggcgacccactccggcaccaggccgaacacggtttccacgtagcggttgaggccttcggcgtcgcgcgcggcggagtcgttcttgaacaggatgccgctgggcttgaggacctggaccagggcggcgatcacgtcgtccttgtgctgttccatggtcgccgaagccagctgcacgacgaggatgtcgccgaaacggtcgaccaccaggcccggcagcaggtcggagtcgccgtagaccaggcggtagaacggcttgtcgaacaggcgctcgcgcagcgacagcgccacgttcaggcggtgtaccagcagcgacttgtccagcgccagcttggcgtcgcgcgacagcaggcgggcgcagatcaggttgttcgggctcatggcgacgacgcccagcggcttgccgccggcggcttccagcactgcctggtcgcctgccttgaagccgtggagtggggtggcggctacatcgatttcgttgctgtagacccacaggtggccggcgcgcaggcggcgatcggcgttggctttgaggcgcaggcttggcagggacatgacgtcgctccggaaaaaagagcgggagtataacgtgttgcgctcgccgagaggctggcgagtggatatgcggtgacagggcaaacccgccgcgaatatcccgcgcccggcctggcattgcccctaggcgcccgttgtaaagttccttccggctggccatgggcgccatctaaagggttagaatcgccgcctagcccagagtgcgtacctatgtcccaagcgatgtcccaagagctttccgccgaacagattcaacaggccctgcaaggcatcagcgtgccgccccaaccgcagatcatggtggatctgcagatggagcagtacatgcccgaccctgacctggaagtgatcgcgcggctgatctcccaggacccgggcctctccggcgccctgctgaaaatcgtcaactcgccgtattacgggctgagcaacaagatcgcttcgatccagcgcgcggtgaacctgctgggcagccgttcgatcatcaacctgatcaacgcgcagtcgatcaagggcgagatgagcgacgaaaccatcgtcaccctcaaccgcttctgggataccgcccaggatgtggcgatgacctgcctgaccctggccaagcgcaccggctcgcaagcggtcgacgaggcttatgccctgggcctgttccacgattgcggcgtgccgctgatgctcaagcgcttccccgactacatgacggtgctggaagaggcctacgccagcgcgggccccgagaaccgcgtggtggatacggaaaaccgtgtgttcaacaccaaccacgcggtggtcggttactacacggccaagtcctggcgcctgccggagcacgtgaccaacgccatcgccaatcaccacaacgccctggcgatcttcagcgacgagtcgtcgcgcaacagccagctgaagaacctgctggcgatcctgaaaatggccgagcatatctgcgcgtcctaccgggtgctgggcaatcaggtcgatgatcatgaatggaacagcatcggccatctgatcctcgattacgtcggtctgtccgactacgacttcgagaacctcaaggaagccgtgcgcgaactgggcgcgcactgattcccgaccacgttatagagaatacgaggcacacatgcctgaattaccggaagtcgaaaccacccggcgcggtatcgcgccgcacctggaagggcagcgcgtcagccgcgtgatcgtgcgcgaccggcgtctgcgctggccgattccggaggacctcgatgtgcgcctgtccggccagcagatcgtcaaggtcgagcgccgcgccaagtacctgctgatcaatgccgaagtcggtaccctgatcagtcacctgggcatgtcgggcaacctgcgcctggtggaggtcggcttgccggcggccaagcacgagcatgtcgacatcgagctggagtccggcctggccctgcgctacaccgacccgcggcgctttggcgcgatgctctggagcctggacccgctcaatcacgaactgctgatccgcctggggccggagccgctgaccgacctgttcgacggcgagcgcctgtatcagctgtcgcggggacgttcgatggcggtcaagccgttcatcatggacaacgcggtggtggtgggggtgggcaatatctatgcgaccgaagcgctgttcgccgccggcatcgacccgcgccgcgaagccaaggggatttcccgggcgcgctacctgaagctggcgatcgagatcaagcgcatcctggccgcggccatcgagcgcggcggcaccaccctgcgcgactttatcggcggcgacgggcagccgggctatttccagcaggaactgttcgtctacgggcgcggcggggaacactgcaaggtctgtggcacggggctgcgggagatcaagctggggcagcgtgcgagcgtgtattgccctaaatgccagagctgatcgcctgtagccgctgccgaaggctgcgataggtccgtaggacctgtggcgatcttactggcgtcgcggccgtttcggccgatcgccgcctttggcagcggctacggccgcaagtctcgatggctgtgttatgccttgccggtgatcttccggtacttggccatcaactcttcttcggtttccggatgggcctcgtccagcgggatgcaatccaccgggcagacctgctggcattgcggctcgtcatagtggccgacgcattgggtgcacaggttcgggtcgatcacgtagatctcttcgccttgggaaatcgcggcgttcgggcactcgggttcgcagacgtcgcagttgatgcaatcgtcggtgatgatcagggacatggggcactccggccggggcggcgggcccaggcatttgaaaaaccaatggcgcaattgtgccgcattggcgagcgcagtgcacgcgggcgcgatgggaggggcgtttgcaggtcgactgcgcggacgctggcgcgggctgcgccagctcccgcgggagttatttcttgaagcgcaaggtcagggcgtcggccacggccggatgcacgaacttgctgatatcgccgcccaatgccgcgatttcccggaccagggtcgaggaaatgaacgaataacgctccgacggcgtgaggaacaggctttccacgtccggcgccagttggcggttcatgttggccagctggaattcgtattcgaagtccgaaaccgcccgcagcccccgcaggaagacattggcgttctgctccttggcgaaatgcgccagcagcgtggaaaaaccgacgacttcaacgttcggcagatgcttggtgacctcgcgagccagttccacacgctgttccaggggaaaaagcgggtttttcttcgggctggcggcgacggcgatgatcacatgatcgaacaggcgcgaggcgcgttcgaccagatcgccatggcccttggtaatagggtcgaaggtacctgggtacaacactcggttcatcgcgtcgtcctggcgggagtccgttggggagtcggatggtatcgcagcctttccggtcggccaagtcgcctgtaacggaagaaagcactatagacgacgaaaataagcggcgttttcacccgcttttcagccgttcggccagggccgtggccagttgcgcggtcaggccgtagaccgacagttgcggattggcgccgatgctggtggggaacagcgaaccgtcgtggatcgacagattggccagctggtgatgccggcccaggctgtcggcgacggcgtttttcgggtcttcgcccatggcgcaaccgcccatcacatgggcgctgcccaggcgggtgcggtacagcgcaaggttcaggccgtcgatcagtgtcttggcctcggccagggtcttcacgtagcgggcatcgctgtgcattggcatgactgctttggcgccgccggcgaactggatctgcgccatgctgtgaaaggcccgccgcacgccgtcccaggcgtagtccgagacctggtagtcgagcaccggcgagccgtcgccgcgcagttccacgctgccgccgctgctgtccgggtgaaaaccgtcgcgcagcagcgcgagcatggcgtgggtgtggggcaactgctgcatgttcagggcgctctgcgggccgaaaccgccgagcagggtggcggccagcgccggttgcagcggcggcacctcgagcttgtaggacattttgccggtggtaccgtccagccactggaaatgatcggagtagatcgactgcggcgccccgtagaaggggttgatcacctggtcgaactgcccggcggaaaagttcaccaggtgcaggaaggtgcgtttgcccaggcgcttgtgcgggtcggccgcgtcggagcgcagcagcagggccgggctgttgatcccgccaccggccagcacgtagtgccgggccttgacctggatggtgcgcccggtgggcgccacgcagcgctcgtccatggccaggcagagcaggctctcgagctggtcgcccttgatctgcaggcgctcggcgcgggccaggtacagcagctcgccgcctttctccagggtcgcgggaatggtggtgaccatcatcgactgcttggcgttggtcgggcagcccatgccgcaatagccgaggttccagcagccgcgcacgttgcgcgggatcacgtgccagctgtagccgagtttctcgcaaccgatcctgatcacgtcgttgttggcgttgggcggcatgatccacggggcgatccccaggcgttgctccatcttcgcgaaccagggcgccatctcggccggactgtggcccttgacgtcgtgctccttggcccagtgctccagggtcggctcgggggtacggaagctggacgtccagttgatcagggtggtgccgccgaccgcgcggccttgcaggatggtgatggcgccatccttgctcatgcggccgatgccttcctgatagaggctggcgtaggcctggtcctcgagcatcttgaagtcgtcgctggtcttgagcggcccttcctcgatcagcagcaccttgtagccggcggcgctgaggatctcggcggtggtgccgccgcccgcgccgctgccgatgatggcgacatccgcttcaagggtcaggttctcctgcaattgcgaaccgttgtaggttttccagcctcgggccaggccttcgcgaaacagatcgggtacgggcatatcaggcgctctcttgttgttctggggcttctgggtgcttgtgtagccgctgccgaaggctgcgacaaggtccgtaggaccttccgagggctttaggagcgcgtctcctgcggagccgatcgcagccttcggcagcggctacagagcgagcagtcttcagattctgggtggcccgggataaccgcaatgggcccaggattcggggcggctgtaccaggccatcatcaccagttgcagcagggacgcgtggcccatgcgcagcaggctgagggagctgttttcccagcgcttgaggaagtgccggatatcgtcggcgctggcgttctcccaactgccccagatgccggtcagggggccgcgcgtgatgcccatgcccagcacgtcgaacagctgctgggtgagcttgagcatttccggcgacaggtggtcgaggctgtgatccaggcttttcagggtggcgtcgagcgccgccggcaacttctcggcggccacggcaccgtcgagcatgaccggaagcagcgcccgcagaatcggcaggtcgctgctgcgcaatgcggcaaagccgctggcaggggtgctggacgagcaaccgctgaggctggcgccgaggccggcggtggtcaggaacgcgctggcgcacaggccgattttcaacaggtcacggcgcgacagtacggatgcggcaggcaggctgggagtcattattgttattacccgcaatggtctggttaacggatgaacagcttctggatcagcttctggatcggtttgccatagggcgggtagatcagccgcgcggcattcaggcgctgcttgctcagcacccccttggccttgctgaaggtcaggaaaccctcgtgaccgtggtaatggcccatgcccgagtggccgatgccgccgaacggcatgtcgtcctgggcgacgtgcagcagggtgtcgttgaggcagaccccgcccgagtgggtttcgttgagcacccgctcctgctcggccttgtcgtagccgaagtaatagagcgccagcgggcgagggcgctggttgatgtaggcgaaggcctggtccaggccggtgtagggcacgatcggtaggatcgggccgaagatctcatcctgcatcaccgtcatgtcgtcgctgacattcagcatcaggctgtggcccatgcgccgttcctggttctcttcgaacagcgggatcagcagcgcgcccttgctggtggcgtcgctgatgtagctgttcaggcgcgccagctgccgcgggttgatgatcgcggtgtagtcggggttgtcgaccagggtcgggaagaaaccacggaccacctggcgataggcgtcgacgaaggcgccgacgcggtgttccgggaccagcacgtagtccggggcgacgcaggtctggccggcgttcatggtcttgccgaaggcgatgcgttcggcggcgtccttgagcggtacgtcgtcggacacgatggccggagacttgccgcccagctccagggtcaccggggtcaggttttccgccgcggcgcgcatcacatgcttgccgatgctggtggcgccggtgaacagcaggtgatcgaagggcagccgggagaaggccacgcccacatcggcttcgcccagcaccacggcgaccaggtcctcggggaacgccttggccagcaggcgcttgagcagcaggccggtggcgggggtcgattcgctgagcttgagcagcacccggttgccggcggcgagcgcgcccaccagcgggccgatggccaggtacagggggtagttccacggcacgatcaccccgaccacgcccaatggctggtagacgaccttggccgaggccggctggaaggccacgccgaccttgcgccgcgaaggtttcatccagcccttgaggtgtttgctggcgtagtggatgccatgcaggctgggcatgagttcggcgagcagggtttcgtcggcgctgcgatggctgaaatcttcgctgatggcatcgatcagggcctggcgttcgctgtcgagcagctcgcgcaggctcttgagccattgctggcgctgggcggccggcggcatggggttggccgcgaaggcctggcgctgggcggcgaacagacggtggagctcatccagctgctggtgggcttccggcaagtaggcgatttcggcagacatgggcgactccgggttttgtgggtgggaagtttttagagtttatgctctaaaatgtcaaatgacatcccgggccggctttgatttatcccgttggggataggtcgtaagatgccgggcaacgccttctcgattaaagcccacgctcatggccccacgcataaaaacccgcgaacgtatcgtccagaacagcctggagctgttcaaccagcaaggcgaacgcagtgtcagcaccaaccacattgcggcccacatggagatttcgccgggcaacctgtattaccacttccccaacaagcaggcgatcatcgccgtgctgttctgcgagtacgaagccctggtcgacagcttcctgcgcctgccccagggccgtaccgtgaccgtcgaggacaagcgctattacctgcaggagctgctggccgccatgtggcgctatcgcttcctgcaccgcgacctggaacacctgctcgacagcgacgccgaactggccgcccgttatcggcgcttctcccagcgctgcctgatccacggcacggcgatctacgaaggtttcgtcgaggccggcatcctgcggatggacaaggtgcagatcgagtccctgaccctcaatgcctggatcatccttacctcctgggtgcgttttttgtgcaccacccgggaaaactccgcgcacctgagcgaagaagccatcaagcgcggcgtgtatcaggtgctggtgctggaagccggatttgtcaccgaccacgcccgggaggcggtcgacgcgctatacgacgagttttacgtgcccctggcgcaagccctggaagaagtgcagtaggatctggatcaagtcatcgttcaattactggagcccgtcatgcccatcgcgcaactgatcagtccacagcaattggccgctcgcctggagcagcccgggctggtgattctcgattgtcgttttgccctggaagacccggattacggccagcgcagttatgccagtggacatctggccggcgcgcattttgccgatctggagcacgacctcagtggccgggtggtcaagggcgtgaccgggcgccatccgctgcccgaaccggcgacgctgatcgcgcgcctgcaagcctggggcatcgacgccgacagtgacatcgtgctttacgacgacggccccggtgcctatgccgcccgcgcctggtggctgctggcctggctgggcaagcgcgacggcgtgttcattctcgatggcggcctgaaagcctggcacgccgcgggcctgccattgagcctggatccaccggccaatgtccccggccacttcactggccagcccgaccaatccctgctgttgagtgccgagcaactgcaaaagcgcctcggccagccgaccctgaccctgctcgacgcccgcgcccagccacgttttcgcggcgaagtggagccgatcgacccggtggccgggcatatccccggcgcgcaatgcgcggctttcaccgacaacctggatagcgacggccgtttcctgccggccgatcagctcaagaagcgctttgccgcgaagctgggcgagcgttcgccgagcgaactggtggcgtactgcggctcgggcgtgactgcctgtcacaacctgttcgccctgtgcctggccggttatcccctgggcaggctgtatgccggctcctggagcgaatggatcaccgatccgcagcgcgcagtcgccacgggcgactgagccaaaagcattcctgtaggagcgagcttgctcgcgaaaaaatcctttcggcagcgtgctctgccagaaatagcgcgccgtctgcaagggaggatcgcgagcaagctcgcttctactagggagtgtcggttcagagggactggcgggcgctgcgataggccgccggccccacgccgtagacctgcttgaactgccggctcagatggctctggtcggcgaaccccaattgtgtcgccacttccagcggcaggcagccgtcgcgcagcagtgcccgggcctgggcgatgcgctgttgcatcagccaggtgtgcggcggcatgccggtggcgcggcggaacacccgggcgaaatggaaaggcgagagattcaccgccacggccagttcctccagggagggcggggccgccagctgcgcttgcagcaactccttggcctggacgatcgcccggtgttcccgcccgggtttgcccggcgccttgaccccggcgtgacgccgcagcagcaagagcatcatttcccgccacagggtctgttgttgcagggcggtggccgggctttccagcagttgatgcaactggcagaaaccgctgaccagatcggggtcgcgatacagcgtggcgccgaaggccggcaggctgtcggtgggtagttccagctcaccgagcatggcgaggatctgcgcgttgtccggataaaacgcccggtacagccagccgtcctcggtgcctttgtggccggtgtgcagttcgtccgggttgatcagcaccagggtgccgcgccccgccaggtgctcggcaccgcgataacggtagcgctgggcgccgtccatgatcatgccgatcacatagccgtcatgcacatggggcacgaagcgatgttcgatgtaacgcgcggccagcaactccacgccagccaggggcgcggtctgccagaaacggatcgactcgccctggccgccgttcatcgcaactcgccccccaggccggccagccactggggaatgcgccgctccaggtaataacccggagtcttcaccgaaccctcgacaaaaccgacgtgcccgcccttggcctgcagctcgaagtgggtgctgccggacagctcgccggcttccggcaggctgtgggggaacacgaaaggatcatccgcggcctggataatcagggtttgcgtgcggatttcccccaggaagtaacggctggaggcgcgccggtaatagtcctgggcgtcggcgaaaccattcagcggcgcggtgacccggccgtcgaagtcccagaaggtgcgcatcttctccagtggcccgagccgctccagcacggccaggccctcatggcgcccgtcgtgctggaactggcgctgcttgtccttgatgtaggccagcatctcgcgcatgaaatgcgcctggtagaccttggaaaacccctggccgatgcggtcggcgcactggtccaggcgaaacggcaccgacaccgcgacggcgccttgcagctggctggcgctgccgctttcccccaggtgcttgagcaatacattgccgcccagtgagtagcccaccgcgaacagcggggcctgcgggcgtttgctgcgcaggtggtcgatggcggcggccaggtcttcgctggcccccgagtggtaactgcgcggcagcaggttgggttcgcccgagcagccacgccagttcagcgccgcgctggcccagccctggctcgccagggccttttgcaggccggccacgtaaggcgagttggaagaaccggtcaggccgtgcagcaccagcaccaggggcgcggtggcggagtgcgggccgtgccagtcgagatcgagaaagtcgccgtcgtcgagccacaggcgttcgcgctggcgctcgaggtgagtggtcttgcgccacagcgggccccacagggtctgcaggtgcgggttgccgaggccgaaggcgggaatgaaacgatctgacggagtaggcacggtgattctcgtcgcagcggtgcgcgtccccggcggggctgcgcaccttttcaggccagtggtttaaccggcgatctctgccgtacgttgccacaaggcgtagtacacctgcccggatttttgctcgcggtgcaggcgccagttcgccgggaggccgagggtcgaaggcgcggtttcactttcggtatagacccaggcgtcgtcggccagccagtcgcgttcttccagcagggcacaggcggccggcagcaggttctgatggaacggcgggtcgaggaacaccaggtcgaaacggctggccggctgggtttccagataacgcagggcgtcggcggtctgcacctggccgacggtgcagcgcagggtgcccaggtgttcgcgcaggcgcgacacggccaggttgctggcatccagcgcctggcccatggcggcgccacgggacaaggcttcgagaaacagcgcgccgctgccggcgaacaggtcgagcaccttggccccggcgacatagggcgctagccagttgaacagggtttcgcgcacccggtccggcgtcgggcgcaggcccggcacatcggggaagctcaggcggcggctgcgccactcgccgccgatgatgcgcagttggcccacaccgttgggctggttatggacaggtttcttgctgggacgcgatgggctggccattagtgctccggaaccccgagcggctgctcggcgggtttgtcagtaggggccggcaacggcttttgcggcacggtcgggccggcggtgacgatgactatcttgtcggcgctcaggtgcttgttcagtacgtcccggacctgctccacggtcaggctctgggactgctgcatgaagtcttcaagatagctcagcggcaggttgtagaagccgatggcgcccagttggccgacgatgtcggcgttgctggcggtggacagcgggaagctgccggccagttcgcgcttggcgtcgtcgagttccttctgggtcgggccggtcttgaggtagtcggcgagcacgtcctgcaccagtttgagggtgccctcgctcatttcggcacgggtttgcaggttgatcatgaacgggccacgggcctgcatcgggctgaagccggaatagacgccgtaggtcaggccgcgcttctcgcgcacttcactcatcagccgggtgccaaaaccaccaccgccaaggatctggttgcccagggacaacgcggcgtagtccggatcgtcacgatcgatgcccagttgcgccaacagcaggctggtctggctggagggatattcgatatggccgatgctggcctgtggctcgctcggttgcgggattttcgccagcgccgggcctttgggcagggcggcggagatctgcgcggcaatcgcctcggcatcgctgcgcgacaggtcgcccaccaatgcaatcaccacgttgccggcggcataggccttggcgtggaacgcccgcagttgggccaggctgatcggcggcacgctctgcgcggtgccatcgctggaatgggcatacggatggctgccgtacaggcgcttcatcagttccaggctcgccagcttgccggggttctgcttctggtactcgaagccggcgagcatctggttcttgatgcgcgccagggagtcggccgggaaagtcggcttgccgacgacatcggcgaacagctgcagggccggcgcgcgcttgtccggcgcgctgaggctgcgcagggacgcgatggccatgtccttgtaggcgccgttgccgaaatcggcacccaggccctcgaaaccttcggcgatcgcgccgacatccttgccggccacgccttcgttgagcatggcgttggtcagcatcgccaggcccggcgcgtcgccatcctggctgctgccggcggcgaaggtcaggcgcatgtcgaacatcggcagctcatgggcttcgacgaacagcaccttggcgccttcggcagtgctccaggtcttgatgtcgaggctgcggcggctcggggccttgccgtcgagctcggtcaaagattgcagcttctggctgctcttggccttgtccagcgcctggctggcgtcggatggggccgcgcgcagcagataaaggccggcggcggcgatcagggccacgagtgccaggccgagcaggaccgggctggcgcttttgcgcttactcatgagcggactcctcaggcaatacgtgggcaacgctcaggcgttcgcgggtgaaataggtacgagcggccttctggatgtcttcaggggtcacgctttgcagttcggcgagttcggtgtccatgagtttccaggacaggccgacggtctccagctggccgatggcggtggcctggctggtgatggagtcacgttcgtagaccaggccggcgatcacctgggcgcgcacgcgttccagttcttcggcggtcggcggggtggttttcagctcttcgagcaggcgccacagcccggcttcggcctgggcgatggttttcttcttctggctgttgggcatggctgaaagcaggaacaggctgtcgccgcgagtgtaggcgtcgaagctcgacgagccgccggacaccagctcttcgccgcgctccaggcgggtcgggatgcgggcgctgtagccgccgtcgagcagcgcggcgatcaggcgcagggcgtgcaccgaatgcttgtcttcggcggtggcgatgctcggcacgttgaaggccagcatcacgctcggcagctgggtcttcacccgcagggtgatctgccgctcgccgggctcggccagttccaggggaatcttcgccgcgggcacggcccgcttgggaatggcgccgaaataacgttgggccagggttttgacttcgtccggggtcacgtcgccgaccaccaccagagtggcattgttcggcacgtaccaggactcataccagtggcgcagttcctcgaccttcatccggttgaggtcggccatccagccgatggtcggcgtgtggtagccgctggccgggtaggccatcgccttgaagcgctcgaaggccttggacatcggcttgtcgtcggtgcgcaggcggcgctcttccttgatcacttcgatttcgcggctgaactcgtcgggcggcaggcgcaggctggccatgcgatcggcttccagctcgaaggccacgcccaggcggtcacgggccagcacctggtaataggcggtgaaatcatcgctggtgaaggcgttctcttcggcgcccaggtcgcgcaggatcagcgaggcttcgccggggccgaccttttcgctgcctttgaacatcatgtgttccagggcgtgggacaaaccggtctggcccggggtttcgtagctggagccgactttgtaccagacctgggagaccacgaccggagcccgatggtcttcgcggaccacgaccttgaggccgttgtcgagggtgaattcgtgggtgggttgtggatcggcagccaaggctgaaaggggcagacaaaccgtactgagcagcaggcctgcggcgcggcgggctagagcattcattcgttttttaaacctgttggactgcccgcttggtcttagcctacgggcgaggaggtgctaggatactgatccgttttactggcggccacgcctatcaggccttcgcagatcagagtgtgcttgagcaggttgcatgggtttccggcaagaagtctggatttaccagctaaacttcgacttttcgccgattttgccgtttcagtcctttagtaaaatcgatctttgagatgccattgggcacctcgacaaaatgttgcgcgtgaacaagccggcggaaacgcagtctgttctgcatcgaatatttatttgccggtgcgccttgatggcgcgtcgctaccttgagatagccgtcctccatgtttggttccaacgacgacaagaagaccccagccgcggctggcgagaagaaaggcctgttcggatggctgcgcaaaaagccgcaggaaaccgtcgtcgaacagccacaagtccctgtcgagcctgccccggctcccgctcccgtgatagaacaagccccggttgccgaggccgcggctcctgtggcgttgccgatcgctgagccgatccggcagcctgaacagcccgcaccagcggccgaacctgctcctgcgccagaactgccgctgacccccgatgccgagcacaagccctggctgaccctgccggtggcggaagagccggtggcgttggtggaagacgcgcaggcgccgcacattactccgccgattccggccgcgaccgatctgcagcaagccgccgagctgttggtggccgagttggcacacagcagcgagccaactgaggcccaggcgcagattgaagcagaggacgtgccacaaccggtgatcgcggctttcgtgaaacccgaacctgttccagaaccggagcctgccccggttgtcgctgctccagttgctccagttgctccagttgctccagttgctccagtcgcggcggtcgaagcgcccgctgtcgccgagccgccccgtgccgaggaaaacaaagtcggcttcttcgctcgcctcaagcagggcctgtccaagaccagcgccagcatcggcgaaggcatggccagcctgttcctgggcaagaagaccatcgacgacgagctgctggaagatatcgaaacccgcctgctgaccgccgacgtgggcgtggaagccactgcggtgatcattcggaacctgacccagaaggtcgcgcgtaaacagctgaccgacgtcgatgcgctgtacaagtcgctgcaggccgagctggcgagcatgctcaagccggtcgagcagccgctgcggatcgcttcgcaaaccaagccgttcgtgatcctggtagtgggcgtcaacggcgccggcaagaccaccaccatcggcaagctggccaagaagctgcagctcgaaggcaagaaggtcatgctcgccgcgggcgacaccttccgcgccgcggcggtggaacagctgcaggtctggggcgagcgcaacaagatcccggtcatcgcccagcacaccggcgccgattcggcttcggtgattttcgacgccgtgcaggccgccaaggcccgtggcatcgatgtgctgatcgccgacaccgccggtcgcctgcacaccaaagacaacctgatggaagagttgaagaaggttcgccgggtgatcggcaagctggacgccgacgcgccgcacgaagtgctgctggtgctcgacgccggtactggccagaacgccatcaaccaggccaagcagttcaaccagacggtcgagctgaccggcctggccctgaccaagctcgatggcaccgccaagggcggggtgatctttgctctggccaagcagttcggcctgccgatccgctacatcggcgtcggtgagggcatcgacgacctgcgtacctttgaagccgaaccctttgtccaggcactgtttgccgagcgggagcgttcatgattcgtttcgaacaggtcggtaagcgttactcgaacggccatgtcggcctgcacgagctgagtttccgggttcgtcgcggcgagtttctgttcgtcaccggccactccggtgccggcaagtccacgctgctgcggttgctgctggccatggagcgtccaaccagcggcaagctgctgttggccggtcaggacctgagcaccatcagcaatgcgcagattccattcctgcggcggcagatcggcgtggtgttccagaaccaccaactgctgttcgatcgcaccgttttcaacaatgtcgccttgccgctgcagatcctcggcctgtccaaggctgaaatcgccaagcgcgtggactcggccctggagcgcgtggcgctctcggacaagaccgatctctacccgggcgacctgtccaccggtcagcagcagcgcgtcggcattgcccgcgccatcgtgcaccgcccggccttgctgctggcggacgaacccacaggtaacctcgacccgcgtctggcggcggaaatcatgggcgtattcgaagatatcaaccgtctgggcaccagcgtgctgatcgccagtcacgacctggcgctgatcgcgcgcatgcgtcaccgcatgctgaccttgcaacgcggccgattgatcggcgatggggaggctggcgtatgagtgcgacccgtagccccaaagtggccgaacgcgtggctccaaaagcctcggaccagccgccgcagaagaaaaagcgcgacgaagacgacggcccggatttcggcaccctgttgcatgcctggatcgaaagccaccgcgccagcctgctggacagcctgcgtcgcttgggcaagcagccgatcggcagcttcttcacctgcctggtgatggccgtggccctgagcctgccgatgggcttgtcgttgttgctcaacaacgtcgagcgcctgggcgggtcctggcagcgcgcggcgcagatttccctgtacctggaactcgacgccagcgccaccgagggcgaaagcctgagcgagcagatcaaggccatgccgggcgtggcggatgccgagttcatcagcaaggacaaggccctggacgagttccagcagcagtccgggctgggcgaggcgctcaaggaattgccgcagaacccgctgccgggcgtggtcctggtcacgccgaacgaagtggacaaggcaaccctggaagccttgcgtcagcgcctggcagaaatgcccaaggtgcagcaggcgcaactggacctggtgtgggtcgagcggctggcggcgatcctcaagctgggcgaccggtttgtcttcggcctgacggtgttgctggtttccgcattacttttggtgataggcaataccattcgtcttcatattgaaaaccgccgcaccgagatagaagtgattaaactcgtcggcggcacggacagttatgtgcggcgtcccttcctttatatgggcgccctgtatggcttcggtgcggggatactgtcctggggtgttctggcgttcggcctcgactggctgaacgacgcggtggtggggctggccggtttgtacggcagtgattttgccctggctggcgtgccggtcgccgatggtctatcactcttgcttggcgcggtgttgttggggtatatcggtgcgtggattgcggtcgcccgccacttgcgggagctggcgccgaaatagtgtctttttgcttgtattgaccttttagaatttttgggaacttgttttgcggtttccggtcaattttcagcagtgctgaataagcacgagttatgtgagtcggaggttttttcgtatgaccacttctttgcaacctgcttatgccttggtcccgggtgcgaacctggaggcctatgtgcacacggtgaacagcattccattgctgacgcccgagcaggagcgtgaactggccgagagtctctactatgagcaggatcttgaggcggctcggcagatggtgctcgcccacctgcgttttgtcgtacatatcgcccgtagctattccggctacggtctggcccaggccgacctgattcaggaaggcaatgtcgggttgatgaaggctgtaaaacgcttcaacccggaaatgggtgtgcgtctggtttcgttcgccgtgcactggatcaaggcggaaatccacgagttcatcctgcgcaactggcgcattgtgaaagtcgcgaccaccaaggcccagcgcaagctgttcttcaacctgcgcagccagaagaagcgcctggcctggttgaacaacgaagaagtccatcgtgtggcggaaagcctcggtgtggagccgcgcgaagtgcgcgagatggaaagccgcctgaccggccatgacatggccttcgacccagccgccgaagcggatgacgacagcgccttccaatcgccggccaactacctggaagaccaccggtacgatccggcccgtcagctggaagatgccgactggaccgacaactccaccagcaacctgcacgaggcgctggaagtgttggacgaccgcagccgcgacattctctaccagcgctggctggcggaagagaaagccacgctgcacgacctggcgcagaagtacaacgtgtcggccgagcgtattcgtcagctcgagaagagcgcgatgaacaagctcaaactgtcgattgccgcgtaatacggccacgcaataaaaaacgccccgatcctatcggggcgtttttgtttgtggcgttggcgctgtggtgtctgtggggacgttatcgcgagcaagcaagaagacgcgggcctgtagcgcgatcgggtcctgggcgtcactgcgcccacagcgccttgcgcgaatcgttcaggcccagcaggtagctgtcgccacccaactggctcatctgccggcggatccagccggctcgttgtgccacatagccgctcggatggctggcgctccatacccgtgggttgggcaggaccgcggccagcaggctggcctgttgccgcgacagcgagcccgcgctgacaccgaagtggtgccgcgccgcggcctcggcgccaaatacgccttcgtcccactcggcgctgttgaggtagacctcgagaatccgttgcttgggccagaagatctcgatcagcccggtgaaccaggcttccagccctttgcgcagccaactgcgcccagaccacaggaacaggtttttcgccacctgctggctcagggtgctggcgccgcgaatcgagccgccgcgctcgttgtgggcgaaggcggcctggatcgcgccaatgtcgaacccccagtgttcagggaacttctggtcttcgccggcgatcaccgccaccttcaggtcgtcggagatttcgtcccagggtttccagctgcgttgcaggtcgatgggctcgccgtcgatccaggattcgatcttgcgttcgaccatcaaggccgtgcccggaggcggcacgacgcggaacaccagcaccagcaaaacgctgccgacggcgaaccagagcagggctttagagaaacgacggaaaaataaacgcagcatagagatggcttggccgaacccattgagcgcgccattatacaggcccgaccgacgattctgactggagttcctcatgctgcgtggcttcctgatgctggccgcctttttcggctttaccggcgttgccctgggcgcatttgccgcccacggcctgaaaaatcgcctgagcgcggaatacctggcgattttccataccggcgtcacctaccagctggtgcatgccctggcgctgctgggtgtggcgctgctggccacgcagattcccggccgcctggcgacctgggccggcgcttcgttcgccatcggcatcctgctgttttccggcagcctctacctgctgaccctgaccggtttcagcaagctgggcatcgtcacccccttcggtggcctggccttcctggtcggctggttatgcctgggtcttgccgcctggcggctgagctgaccggcaggtccatttcgagacgaatggcttgggtcggccagactgatcgggctagaatgctggcccctaaaaatgatggcggcattcggcatgcgcattcaattgaacggcgaatcctttgaactgcccgacggcgaaaccgttgcggccctgctgacccgtctggacctgaccggacgccggatcgcggtcgaactcaacctggatatcgtcccgcgcagccagcacgccgagaccaccctcaacgagggcgatcaggtcgaagtggtacacgccatcggcggcggctagccacccgagccagggctggccccacccacgcattctgcaagaacctcaccccaacagaggatttccgatgagcaacgttcgcagcgacaagcctttcgtcctggccggtcgtacttaccagtcgcgtttgctggtaggcaccggcaagtaccgtgacatggaagaaacccgcctggccatcgaagcctcgggggccgagatcgtcaccgtcgccgtgcgccggaccaatatcgggcagaacccgggcgaaccgaacctgctggatatcctgccgccggatcgctacaccatcctgccgaacaccgctggctgctatgacgcggtcgaggccgtgcgcacctgccgcctggcccgtgagctgctcgacggtcacaacctggtgaagctggaagtgctggccgaccagaaaaccctgttccccaacgtgctggaaaccctcaaggccgccgaagtgctggtcaaggaaggtttcgacgtgatggtgtacaccagcgatgacccgatcatcgcccgccagctggcggaaatgggctgcatcgcggtcatgccgctggccggcctgatcggtaccggcctggggatctgcaacccgtacaacctgcagatcatcctcgaagaagccaaggtcccggtgctggtggatgccggtgtcggcactgcctccgacgccaccatcgccatggagctgggttgcgaagcggtgctgatgaactcggccatcgcccatgcgcaacaaccggtgctgatggccgaagccatgaagcacgccattgtggcaggccgcctggcgtacctcgccggccgcatgccgaagaaactctatgccagcgcctcctcgccgctggatggtctgatcaagtaagagccattgatgactgaatcaaacgacacgccaatccagccggaagccggcgacgagcgccaacaccgccgcatcaagagtttcgtgatgcgcgccgggcgcatgaccgaaggccagcagcgcggcctggagcagggcgcgccgctgtatgtgctgccgctggccgacgcgccggtggatttcgatcaggtgtttggtcgctcggcgccacgctccctggaaatcggcttcggcatgggccactcgctgctggaaatggccgcagccgcgccggagcaggatttcatcggtgtggaagtgcaccgtccgggtgtcggcgcgttgctcaacggcgtgctgacccagggcctgaccaacctgcgggtctacgattgcgatgcgatcgaagtgctcaaccgctgcatcgccgataacagcctggatcgcctgatgctgtttttccccgatccgtggcacaagagccgtcaccacaagcggcgtatcgtccaggcgtccttcgccgagctggtgcgcagcaagctaaaggtcggcggcatcctgcatatggccaccgattgggagccttatgccgagtacatgctggaagtgatgaatgtcgcgccgggttaccgcaacctggccgaagacggcaagtgcgtgccgcgcccggccgaacgcccgatcaccaagttcgagcgccgcggcgaacgcctgggccatggggtgtgggacctgaagttcgaaaagctggcgtgagccctgctgtgtaggagcatccggtcgatgctcgattgctcgcgatcggctgccaggctgaaagatagcggcgctgcgaagtccgctatcgcgagcaagcttcgctcctacaggggcgagaggaaatcgacgggaacgtgatcggtcagccagaccccgttctccgcctgatagaacttgaagccctgcgcctgcatgtcctgtgcggcgatcttgagtatcaccaccttcccgtaacgctgccccaccgcttcggcggttgccgggtcctgtgacaggtgcacgtgatgacgtgagcctgggatcaggcctttctcgttgatcgagtccatgaaccgcgtggcggtaccgtggtaaagcacggccggtggctgctgttcagcgagttgcaggctcacggtcttgctggaatgaccttgcacggcgcggatgcgctggccgtcctcggacagggcaaagcgtttcttgtcgttgctggcgaccacctcggcgatcagttcgggtgtcagctggcgtccttccctggctgcaccgccgatcaaggcctcgacttcggcccagccttcgctgtccagccgcaggccaatcgcctgcggctcgtggcgtagcacgtagctgaggaacttgctgacttcttcggcggctttcctgctcatattcatccttgtgcataagtcatgtagtcgctgccgcaggctacgatcggttgcgaagcgactgccaagcctgtcgatgcgatacgtcaggtgtaactcggtgtctgggtttatggctgctgcgcagccaatcgcagcctgcggcagcggctacaggtcagcgacggtcggcgacgacaccgatcagcaccagcaccaccagcagcactggcgccaggctgtagttgttgaactggctcaggccgcggacgatccacggcgtggcgtagatcaacgcggcaccgctgccgatcatgcacagcagcgccatcatcggtacgcgcagggcgccggcgaggccacccaggcgtgcttcgacccagcccttgatatcggcgccgaacagcaccaacaggcagccgacgagggccagggagatttctgaaaggttgctgcgactccagcgggacacggtagcgagcaggtcgagtatcaaatccattcgttttcccttagggctgaaatcagctcagaaatttctgcagcaagtcattgaggaacagctggccgcgcggggtggcggccaggcgtgacggttcgacctgcaacaggccgctttgttcggcgtcgcggcgaccttcggcgaggctttccaggggcagcccggtacgctgcggatacagccgcgcctcgacgccctcggtcaggcgcagggcgttcatcaggaactcgaacggcagctcttcgttgctcaggtccttttcgccggccttgaagtgtttcgccgggttgaggtagtccttgggcaggcgggtcttccaggtgcgcacgatgcgcccgtccggatggctgagcttgccgtgggcgccggcgccgatgccgatgaagtcgccgaagctccagtaattgaggttgtgccgggccgcccgaccgggctgggcataggccgagacttcgtactggacgtagccgtgctcggccaaaagcgcctggccggcttcctggatgtcccacagggtgtcgtcttccggcagcgttggcggctggttccagaacaccgtattgggttccagggtcagctggtaccaggacaggtgggtcggtttcatggcgatggcctggcgcaggtcgcccagggcgtcgtccagggactggtcgggcaggccgtgcatcaggtccaggttgaagttgtcgaacccggcctggcgcgccatgccggcggcgcgcacggcttcgtcgccattgtggatgcggcccagggccttgagcttgtcttcctggaagctctggatgccgattgacaggcgattgatgcccagggcgcgataggcggtgaacttctcctgttcgaaggtcccggggttggcttccagggtgatctcgatgtcgcgggcgaacgggatgcgttgctccacgcctttgagcaaccggcccagggcctgggcactgaacaggctcggcgtgccgccgccgaagaagatcgaactcagctcgcggccgtagacggcgggcaggtcctggtcgaggtcggccagcagggcgtcgacgtactcttcttccggcagcaccgggctggcggcgtgggagttgaagtcgcagtaagggcatttgcgtacacaccacgggatgtggatgtacagcgccaggggcggcagctggggcagggccgcccggggcgtttgcgcaccgccgagaatcagcggtggcgcggacgaatcaatggtcattgcaggctcaagcgttgccgcagaatggccatggcgcgggcgcgatggctgagttggttcttttggatcgggtccagctcggcgctggagcagttgcgctccggcacccagaacagcgggtcgtagccgaaaccgtgctcgccgctggcggccgtgaggatgcgcccgtgccacaggccttcgcagaggatcggcagtggatcctcggcatgtcgcaccagcgccagcacacagacgaactgcgcgccgcgctcggcctcgggaacgtccttcagggcgtccagcagcttggcgttgttcgccgcgtcgccctggccgtcggcgtagcgcgccgaatagatgcccggcgcgccgccgaggaaatccaccgccaggcccgaatcgtccgccagcgccggcaggccggaaatgcgcgaagcgttgcgggccttgaggatggcgttctcgacgaacgacaggccggtttcttccggctcgacgctgctgaactcgccgatcgagcgcaggtgcaccgagtcgccgagcatggcctggagttccttgagtttgccggcgttatggctggccagtacgagttgggtaaaagtcatcattcgccggggaaaagctcttggttgaagttgatggtgttgatcgcgtcaccggtctgcaccttgatttcgaaggtgcgggtttcctgctgttccaccgggtactgggcgatgtagtagatcgcgccctgttcggtgacctgcttgaatttcagcggcaccgactggctggtcaggtccttgacggtcccggtgacctgggcgaccagcggtttgccggccttgagcacggaaacgttgatcacgccctggttcttgctgcgcaccagctccgcggccttggcgatatccggttgcaggaaggtggagttgaaggtgttgtagtgcacggtcacgtcaccgaacacttcctggcgctcgcccttgatggtgtcggcggccatcgccgacgcgctcaggcacgctgccaatagaaaagtaaccaagcgacccatgatcgttctccttgctttgaacctggtttataccgcgatctggtggtcctgcaggccggggctgctgacgcggtagatgccgatctcacctaacagattaggccatagcttactggcccacccgtgccggtgctgttgatccaccgcaaggcgatcgatgaccttggcttcacgttcgcggcaaagctcttcaaagtcctcgaacgtgcagaagtggatgttcggcgtgttgtaccaggtgtacggcaggaattcggagaccggcatccgccccttgctggccaggtaccagcggcagcgccagtggccgaagttggggaaggtgatgatgcactgacggcctacccgcagcatttcgtcgaggatccgatccgggtagtgcacggcctgcagggcctgggtcatgaccacgatatcgaagctgttgctggcgaagttgcccaggcccttgtccaggtcctgctcgatgacgttgatgcccttggccacgcactcggcgatgttgtccgggtcgttttccaggccgtagccggtgacttgcttgtgatcgcgcagccagctcagcagttcgccattgccgcaaccgaggtcgagcacgcggctgccggcggggatccattcttggatgatttccagatcggctctcatggcgtcctcacagcgttatacggttcatgtagttgccgaacgcctgcaggtaacgcgggatcggaatcaggaaggcgtcgtggccctgtggggcatcgatttccaggtagctgacgtccttgcgcgcggccatcagggcatccaccagctcccgcgagcgggccggggagaagcgccagtcggtggtgaaggacatcacgcagaacttggccttggcgccttcgaaggttttcgccaggttatcgtcgaagttcgccgccggatcgaaataatccagcgccttggtcatcagcaggtaggtgttggcgtcgaaccgcccggagaactcctcgccctgataacgcaggtagctttcgacctggaactcgacgctgtggaagtcgtagttgagcttttcgctcttcaggccacggccgaatttctcgcccatggagtcgtcggacaggtaggtgatgtgcccgaccatccgcgccagcatcagcccgcgcttggggatcacgccctgttcctggaacgaaccgccgtggaattcggggtcggtgaggatggcctggcgcgcgacttcgttgaaggcgatgttctgcgccgacagcttgggcgccgaagcgatggccaggcaatggcgcacccggtccgggtaggtgatggtccattgcagggcctgcatgccgcccaggctgccgccgatcacggcggcccactggtggatgccaatgcggtcggccaggcgcgcctggctgtgcacccagtcttccacggtcagcaccgggaaatcggcgccgaacggcttgccggtgtccgggttgatgctgctcgggccggtggagccgttgcagccgccgaggttgttcaggctgacgacgaagaacttgttggtgtcgatcggcttgcccgggccgatgcagctgtcccaccagcccggcttgcggtcgtcggggctgtggtagccggcggcgtggtgatggccggacagggcgtggcagatcagcacggcattgctcgccgtggcgttcagctggccgtaggtctcgtagatcagatcataggctggcagggagcggccgcaggccagggccaggggctcgctgaaatgcgccacttgcggcgtcaccagaccaacggaatcggcgggaaaggcagttggcatcgaccctgctctcgtttaaatgaggcgtaagtctaaagaccgctgcccccagcggcaagcaaaggccggggctgattctcccgcgacttgtgacgaaccttgtagccgctgccgcaggctgcgatcggctccgcaggagacgtgctcttgagggcctcgaagggccttcggcccttatcgcagcctgcggcagcggctacagagagtgatcaggatggacgctgcagtccgggcagatccgggagttttttcggtgcgttgatccgcacccgtttctgccggttcagctcgccgctgatcaggctgacctggctcttggacacgccgaacgccttggccaggaacgccatcaaataagcgttggccttgccctccatcggcggtgcggtgaggcggatcttcaggcgctcgccatgcagcccggcgaagtcatcgctacgggccgcaggttgcaggtggcactccaggatcaggtcgtcgccgtcccaacgaaagtagctcacaggatcagatcagcagacgcaggatttccggcatcatggtcatggccgccaggttgttgatcaccagcatgtcgatcagcttgagcaccatgaacgccaggatcggcgagatatccaggccgcccatgctcggcaggatgcggcggaacggcgccagggccggctcgcagatctggttgaccagctcggcgcccgggttatggctgcccggggcgacccaggaaaggatcacgctgatgatcagggcgaagaagaaaatcttcatgaacagcgcggtcacgccgatgatcgaccagatcagcagttgcagcgggttgccggtggtgccgtaggtcagcagcagggtcagggccatcagcagcagttgtacgacgatcgccaggatcagcgacgacatgtccaggccgaacaggctcgggatgacccggcgcatcggcttgagcagcggctgggtggcgcgcacggcgaactggcacagcgggttgtagaagtcggcgcgtaccagttgcagcacgaagcgcagcagcacgatcagcaggtacaggctgcccagggtttgcagcacgtacaccgccgcagtgttcaatccaatcatcattggctccttattggcccagttgttcggccatctcggccgagcggtgcgcggcggcacccaatgctttttccaccagggcttcgaagccactggcctggaacgacttgatcgcggcttccgtggtcccggctggcgaggtcacgcggcggcgcagttcggccgcgtccacgtcgctggacaccgccatgtgcgccgcgcccagcgcggtctggagggtcagttggcgggcggtttcccgtggcaggccgagcttctcgccggcggcggtcatcgcttcgatcagcaggaagaaatacgccgggccgctgccggacaccgcggtcaccgcgtccagttgctgttcctgttccagccacaggacgatgcccacggccgacagcagttcttcggcctgctggcgttgcgccgcgctcaccgcggcggtggcatacagtccgctggcgccctggcgcagcagggccggggtgttgggcatgcagcgcacgatcggctgttcgccgagccacttgttcatgctggcgcaggtgatgccggcggcgatggacacgatcaactggtgcggtttcaggctggggcgcagggcttcgcacacggccttcatggcctgtggcttgaccgccagcaccactacgtcgacgccggcgatggcctcggcgttatcggcgaacagttcaatgccgtgctcggcctggaccttggcgcgggtttcggcgcccgggtcgctggcgcggatctggctggcgtccaggcccttggcgcgcaggccgccgatcaagctggcagccatgttgccggcgccgataaaggcgatacgagtcttgctcatgacaggtccttattcagaggtgaggccgccacagtcatggctggccataatcgcgtgcgccaaacaaagcggtaccgatacgtacccaggtggcgccttgggcaatggccgcttcgaggtcgtggctcatgcccatggaaagtgtgtcggttggcaggtccaggctgtcgcgcaggttgtcgttcaggctgcgcacggccgcgaaggcggcgtcctgggcggcacgatcttcagtcggctcgggaatcgccatcagcccgcgcagttgcaggcgcggcaaggcgctgatggcgctggccagggccggcaggtcggccggtgtgcagccagatttgctggcctcgccactgacattgacctgaatgcagatgttcagcggcggcaagtcggccgggcgttgctcggacaggcgttgagcgattttcaagcgatccacggaatgcacccaggcgaagttctcggcgatagctcgcgtcttgttcgactgaatggggccgatgaagtgccaactcaagggcaggtcgccaagttccgcctgtttgcccagggcttcttgcaggtagttctcgccgaagtcgcgcaggccggccgcgtaggcttcacgcagcgccgcggcgggcttggtcttgctcacggccagcaaatggatgctgctttcgtcacgttgcgaggcctgcgccgcggcacggatccgtgcgctaaccagggcaatgttgtctgctatcgtggacattcgatgtacgccagcgggtcttgggttcgcggcattctactggaattggggaacgctatggatatcactgagttgctggccttcagcgtcaaacagggcgcttcggacctgcacctctcggccggtttgccgccgatgattcgcatcgacggcgatattcgccggatcaacctgccggtgctggaggcgcagcaggtgcacgagctgatcctggccagcatgactgatccgcaacgggccgagttcaaggccgcgctggagatcgacttttccttcgcggtgccgggcctggcgcgctttcgggtcaatgccttcaaccatcagcgcggcgccggcgcggtctttcgcagtattgcggacaaggtgccgggcatggacgagctgggcatgggcgaggtgtttcgtcggatcagcgaagtgccccgcggcctggtgctggtgaccgggccgaccggctcgggcaagtcgaccaccctggcggcgatgatcgatcacctgaaccagagccggcaccagcacatcctcaccatcgaggatcccatcgagttcatccacgaatcgaaaaagtgcctgatcaaccagcgcgaggtgcatcgcgacacctgcagcttctccacggccctgcgctcggccctgcgcgaagacccggatgtgattctggtgggggaaatgcgcgacctggaaaccatccgcctggcgctgaccgccgcggagaccgggcatctggtgttcggcaccctgcacaccacgtcggcggcgaaaaccgtagaccgggtggtggacgtgttcccggccgaggagaaggcgatggttcgctccatgctctcggagtcgctgcaggcagtgatttcccagacgctggtgaagcgtatcggcggaggccgggtagcggctcacgagatcatgctgggcagcgcggcgatccgtaacctgatccgcgaggacaaggtggcgcagatgtactcggcgatccagaccggcggggcgctggggatgcagaccctggacatgagcctgaaggcgttggtggatgcggggctggtcagccgggagcacgcccgggaaaaggcgcgggcgccggacagtatttgaagaggtatcggagcggcaaatgcaatcgcgagccatcgagcatggtggctcgatggctcgcgatcagggagggcgatcagcgctgaacgatgcgcagggtgttctgctcttttggcagaacccgcttggccactacgtagttcttgtcccagtacggcttcttcagggtatcgatggtcaccgacttgccgcggcgcggcgcgtggatgaagcgatcgttgcccaggtagatggcgacgtggttgacccggcggctcttgaggttgaagaacagcaggtcgccaggcttgaggtccttgcgctcgactttctgcccgtgaccgctggccatggcgttcgaggtgcgcggcagatcgacggcggcgacgtcgttgaaggcgtatttcaccaggccgctgcagtcgaagcctttacttgggctgctgccgccccaacggtaaggggtgcccagtacgttgacggcacggctgagcacggtgctgctctgcttggccgccatctgcggtaccggcttgctgctgacgctgctcaggtgagtcgggcgtttgaccgacagcttgttcttggagctgttcttgctgacttgggtaacgtgggcttttggagtgaagccgttcacattgggaagacgttgctcacgattggtggcgtgggcagccagtggcatcaataggcaaatggttagccatgtcttgaaaaatggacgcattaggcaaggctcatatgggttagcgcgcaactttataacagcttttttgtcacttctcaggccgttggtcgattcaacctggaggtcaaattcgctgaagaggcggcaaattgacgcaattgtccgacagaagtcaggcagtacaagggtttcacggcagcgaccttaacatttgccacacgtcggctgcctgtaaaaaagtcacaaagaattaaagaaaatttatctattgcgtggaacgaggtactcaatgaacacctatcgcccggacggttcgacccatgacacccacagcaaggtgatcggttacctgttgtggattttcggttttaccggctctcaccgcttctattacggcaagccgattaccggaactatctggttcttcaccctgggcttgctgggcatcggctggctgatcgacctgttcctgatcccggccatggaccgcgaggccgacctgcgttttaccccgggacccatcgaatacagcgtcgcctggatcctcctgacctttctcgggatcttcggtgtgcaccgcatgtatcagggcaaatggatcagcggcctgctgtacctgctgactggcggggtgttctttctgggggtcttgtatgacttctggacgctgaacgaccaggtgtcgttgcgtaacgcgcagcggcgttgaatgcaggagcgccatcgcgagcaagctcgcccctacagaagaagtgcggcgcccatggggtctgcgccgtacctgtaggagcgagcttgctcgcgatcatggctcgtcagcccttgtggctgatccgtccgtccaccagggtgtaacgcaccacgcccggcaggctatggccgaggaacgggcagttctcgcctttcgacaaccagtgttcgccggccacggtggacgtgctcgggtcgaacaacaccaggtccgccggagcgcctaccgccagcttgccggccggcaggcgcagggcgtcggccgggccgctgctcaggcgtgccagcagggtcggcaggtcgagcaggccgtcttccaccagggtcatggccagcggcagcagcagctcgacgctgctgatgcccggctcggtggcgccgaaaggcgccagcttggcgtcgcgttcgtggggctggtgatggctggagatggcctggaccaccccggacttcacggcctcgcgcaggccttcgcggtcggcgcgcgagcgcagcggcggctggacgtgatagaggctggagaagtcgatcagcgcgtcgtcggtgaggatcagctggtacagcgccacgtcggcggtcaccggcaggccacgggcctgggcctgggcgatcagggccacgccccgggcgctggtcagctggctgaagtgggcgcgcacgccgctttgctccaccagcagcaggtcacgggccagggccacggtttccgcggtttccggaatgcccggcaggccgaggaagctggcggtggcgccttcgtgggccaggccgccttcggccaggtcgcggtcctgggagtggaaaatcaccgtcaggtcgaaggttgccgcgtattccagcgcccggcacaaggtgcgggtgctgcgaaagccctccagaccgttgccgaaggccacgcaaccggcgtcgcgcagggcgatcagctcggccagctgttcgccgtccaggcctttgctcagggcaccgatcgggaacactttggtattgccggcttcgcgggcgcgatcgaggatcagctcggccactgccgaggtgtccagcaccggcttggtacgcggcgggcagcacaggctggtgacgccaccggcggcggcggcgcgggtttcgctggcgatggtgcctttgcggctgtagcccggctcgcgcagggagacgttcaggtccaccagcccgggcgcggccaccaggcctttggcgtcgaggcgttcagccgcgttgaaaccggcgggcgcggcgccgatagcatgatcaccacgtcgacgtctttcaggccttcggccatgtcggtgtagaccttcaccccgtattgctcgatgccgatcggcagcagggtcttgggcgcgatcacgcggatgtccgggcaacccagggttttcagggccagcatgttcgagcgcgccacccgcgagtgcaggatgtcgccgacgatggccaccgagaggttttcgaagccgcccttgtgccgacggatggtgagcatgtcgagcatgccctgggtcgggtgggcgtggcggccgtcgccgccgttgatgatcgccacctgcgggcacacatgttcggcgatgaagtgcgcggcgccggagtctccgtggcgcacgacgaacatgtcggcggccatggcttcgaggttgcgcagggtgtcgagcagggtttcacccttgctggccgaggaggtggacacgttgagcgtgatcacgtccgccgacaggcgctgggccgccagttcgaaggtggtgcgggtgcgggtggagttctcgaagaacacgttgcacacggtcttgccgcgtagcaaagggactttcttgacggcccgggcgccgacttcgaggaaggagtcggcggtgtcgaggatttccgtcagcagctcgcgacgcagaccgtcgagcgagaggaagtggcgcagctggccctgatcgttgagctgcagcgggcgcttggcgtctagaggcgtcatcgcaatggactctttagaggggcgaattaaagggcgaggtcttgaagctcgagttgaagcggcgcaggaccggacaattttacccgctcgtgggcggccagcgacagggtggcgccgaccacattcggacgaatcggcagctcggcggcgtccaggtccagcaggcagaccagggtcacgctggccgggcggccgtagtcgaacagctcgttgagggcggcgcggatggtgcggccgctcatcagcacgtcgtcgatcaggatcaggtgctggccctcgatctcgaacggcagctcggaagggcgcacttgcggatgcaggccgttctggctgaagtcgtcgcggtagaaggacacatccagggtgcccagcggcgcgtcgctgcccagttcggcgagtagggcctgggcgacccagacgccgccggtacggatgccgatgtagcggggctcgctgatggcgcgttgttccaggtgggcggtgagacgcacggccatctggctgatcagttcggcgggattgggcaggctcatgattgctccttcgtgggcccgcgcctggttgcatgcagcaaggcgcagggtcttacggctggtgttgtggccaggaggcgcatggccgggggttgaccacgcatcttcaggattcggcgtttcagttgttcaacagcgctgcgttttcgtcgagccagccttgcagcagcagggcggcggcgatggcgtcgaccgggttgtcgcggtaactgcctttctggccgccgcgggccaggcgttcgcccttggcctcgaaggtggtcaggcgttcgtcatgggtatagaagggcaggttgtagcggccattgaggcgccgggcgaacttctcggcgcgcacgcacatctcgctcggggtgccgtccatgttcaatggcaggccgaccaccaccgcatccggcttccattccttgatcagggcttcgacctggttccagtccggcacgccgttctgcgccttcagggtgcacagctcgcgggcctggccggtgatggcctggccgaccgccacgccgatctgcttggtgccgtagtcgaacccgaggatcagtcgcagggccatcaggcgtggcccgcctggctggtcagcagggcgaggttgatgcccaggtgcttggccgccgcttccaggcgcagttcgctgctggtgttgaacaggatgtcggcgtcgaacgggcaggtcagccaggcgttgtccgccagctcggcttccagctgcccggcttcccagccggcataaccgagggcgatcaggcttttggccggaccgacgccatcggcgatggcgaacagcacgtcctgggacgtcgacagcgacaggccatcaagctcgaccgtggcctggaaggtcgggccgctggggtgcaggacaaaaccgcgatcggtctgcaccgggccgccgatgaagatcggcacatgctggcagagcgctggcgggtcgatctcggggcgcaattgctcgaggatatcggcgaggttcaggtcctgcggacggttgaccaccaaccccatggcgccattggcattgtgctcgacgatgtaggtcaaggtgtgcgcaaagttcgggtcggccatgtgcggcatggcgatcaggaagtgatgcttgaggtagctggggctgacgtttttcatgagcgctagtgtggcggtggaggggcgaactgacaagctggggatgctctcattccccatgaatcctgtagccgctgtcgagcttgcgaggctgcgtacgactgcgcagcaggcgcaaacctgcccgcacgttttgcctggcacaccgcatggacattttttgcggccgctacgcgcccgtacgcagcctcgcaggctcggcagcggctacaagaggtaggggatcagttgctggacagccggtcgccgcgggcgaacttccaggtgcggatgatctccaggcggtcgatatccgacaggtcgccggtaaagggcgcgaacggcgccgccaggcgcacgatgcgctgggccgcctggtccagcagcggctggccggaggactccagcaccagcacctcgtacagagaaccgtcgcggttgatcgagaccatcagccgcaggttgccgtagatttgcttgcgccgggcttcttccgggtagttgaggttgccgatgcgctcgaccttcttgcgccactcgtccttgtaccaggcgcccttgtcgcgcatggtcgaggccgcgctcaggcggtggatgcgcgggcgcttggcgtacagctgctgctcctgggccagttcggcctccaggctggcgatgtcgctggacagctgctcgctgtcgaacgtcggcaccggaaccttgggtttggcctcggtcttgacctcttcacgctgggtgacggtctttttcggtttcggcgcggtggtggcgaccgcggccttgggcgcggcttgcttgacttcggtcttggccggaggcggcggggtgaccttgttcaccttgttttcctggaacggcgccacttcggtggtcttcgggatcgccttcttgtccagggtgccgctgccttgctggttttcctgggcgagaaaatcggccttcttcggcttggtctcgctcttgaaggtggccagggtgatttccagggtcttgctgatctgcttgggttcggcgaaggagaagcccaggccgagaatcagcgcgatatgcagcagggcggccaggaacagggtaaaccccaggcgatcggccgggcgcacaccgctgtgggccagctcggggggcagatcggaagggagagccattagcggttcacaaaagtcatcagcggttcaacatcacaaaaagcatcacaagaccaacatcgcgcgtttcacaggcggcgcatgataacgcaatgttggtttcaagccgtaagcctcaagcttcaagcgacaagctgcatgtgacgccgatcaagcttgtggcttgcggctcgcggcttgcagcttcttctcgatggcatccatcagcattgcgccgatgttggtgccaaaggcgttgtcgatctcgcggatgcaggtcgggctggtgacgttgatttcggtcaggtgctcgccgatcacgtcgagccccacgaacagcaggcctttctcgcgcagggtcgggccgacctgtgcggcgatccagcgatctttctcggtcagcggccgggcttcgccacggccaccggcggcgaggttgccacgggtttcaccctgggcgggaatccgtgccaggcagtaatccacaggttcgccgtcgatcatcaggatgcgtttgtcgccatcgacgatggccggcaggtactcctggatcatgatctgctgcttgccgtgctgggtcagggtttcgaggatcaccgagaggttcgggtggccggcggtgtggcggaagatcgacgagccgcccatgccgtccagcggtttgaggatcacgtcgccgtgatggtcggcgaattcgcgcaacacgtccggacgacggctgacgatggtcggcggcgtgcactgcgggaacagggtggcgaacagcttttcattgcagtcacgcaggctctgcggcttgttgaccaccagcacgccgtcgcgctcggcctgctccagcaggtaggtggagtagacgaactccatgtcgaacggtgggtccttgcgcatcaggatcacgtccagctcgctcagggcgctgtcggtctcggcttccagttcgaaccacttgtgcgggtcggcgaacaccttcagcgggcgcatccgcgcccgggccacgccaccggtcgcctggtacaggtcgcgctgttccatatagaacagggtccagccgcgctcctgggcggccagcagcatggccagcgaactgtccttcttataggagatgctggcgatagggtccatgacaatcccgacgcgaacgctcatgggcggtttcctcgaaaattagtgggcgcaatggcttgaaaaagtggcgtcagagtggcgctcgggcggttcccggtcaaggaaaaaccaccgcgccggtcggccgatagattgcatggggagagtatgctaaaaaggctcgcatgccgtgctcaggccttgaacatcaagggcttggggcattggccaccagtacgggcagaaaatcgattcgctgtggcgatggtagagcagatatggaacagcaatccagcgccctcaaggtgatggtgatcgatgattcgaagacgattcgccgcacggccgaaacgctgctgaagaatgtgggctgtgaagtcatcaccgcggtcgacggtttcgaggccctggccaagatcgccgacaaccacccgggcatcatcttcgtcgacatcatgatgccgcggctcgatggctatcagacctgcgcgttgatcaagaacaacagcgcgttcaagtccacgccggtgattatgctgtcctccaaggacggcctgttcgacaaggccaagggtcgcatcgtcggctctgaccagtttttgaccaagcctttcagcaaggaagagctgctgagcgcgatcaaggcccatgtgccggggttcgccgcagtagaacaagcacattgaggttcggccagcgggccgcacgcctattcgtatggggaagaccatggctcgtattctgatcgtcgatgactcgccgactgaaatgtacaaactgaccggcatgctggaaaagcacggccatgaagtcctgaaggccgaaaacggcgccgacggcgtggccctggcgcgccaggaaaagcccgacgcggtcctgatggacatcgtcatgcccggcctcaatggtttccaggcgacccgtcagttgaccaaggatgcggaaaccagccatatcccggtgattatcatcaccaccaaggatcaggaaaccgacaaggtctggggtactcgccagggcgcgaaggattacctgaccaagccggtcgacgaagacaccctgatcaagaccctgaacagcgtcctggccggctgaccgcccgcgccatggccgagtcgcaaaccgccttcgaactgctgctcgagatcgaccagcgctgccgcctgctggcagccgacctgccttcccaggaaacccgccagcacggctggagcggtatcggctttcgcatcggcgagcattggtatgtggcgccgatgggcgaagtcagcgaagtcctgcacgagccccgttacaccctgctgcccggggtcaagccctgggtgaaaggcgtggccaacctgcgcggacggctgctgccgatcatggacctgtgcgggttcttcggccatgagctgtcggccctgcgcaagcagcggcgggtgctggtggtcgagcacaaagaggtgttcgccggcttgatggtggacgaggtggccggcatgcagcacttcgagcagagcagcctggaaaccgcggccaacgctagcgagcagggcgccatcacgccgtacctgcgggggtatttcccgtgtgagccggtctggtgggtattcagtcccttcgccctggcgcagtcgccggggttcctggatgtggcgctgtaggcgcgaggcttgctcgcgatgaatattgcgcgatgaacctgcaggaccgcgccgtccatggcgcgggcaacagaacaaccggaattcaggtgtgcagatgctaaaagccaacccaggcaagccaatggaaggatcgcgcagccgctcgcagatcatcgtgctgttcatcgccctgatcgtgttcatcatgctgctgttcgccaacttcgcttacctcaacacccaggccacgtacgacaagcagtacatcggccacgccggcgagttgcgggtgctgtcccagcgcattgccaagaacgccacggaagccgcggcgggcaaggccgcggccttcaagctgctgggcgatgcgcgcaacgatttcgcccagcgctggggctacctgaaaaaaggcgacccggccaccgggctgcccgccgcgccggtggcggtgcgtcaggaaatgcgcgcggtgcagcaggactgggacaagctgctgcacaacgccgacgcgatcctggccagcgaacagaccgtattgtccctgcatcaggtggccgcgaccctggcggaaaccgtgccgcagttgcaggtcgagtatgaaaaggtcgtggagatcctcctgcaacgcggcgctccggccgcccaggtggccatggcgcaacgccagtcgctgctcgccgagcgtattctcggcgcggtgaataccgtgctggccggcgacgaaaacgcggtgcaggccgccgacgccttcggccgtgacgcggcgcgcttcggccaggtgctgagtggcatgctccagggcaacccgaccctgaagatcagccaggtcgaggaccgcgatgcgcgggcgcgcctgaccgagatcagcgaactgttccagttcgtctcaggctcggtggacgaaatcctcgaaacctcccccgagctgttccaggtccgcgaatcggcgagcaatatcttcagcctgtcgcagaccctgctcgacgaggcctcgcacctggccatcggtttcgagaacctggccggcggccgttcgctggacaccatcggcggttatgtcctgggcctggcggcgctggcctcgatcatcctcattggcctggtgatggtccgcgaaaccaatcgccagctgcatgagactgcggagaagaacgagcgcaaccagaacgcgatcatgcgtttgctggacgagatcgaagacctggccgacggcgacctcaccgtgaccgcctcggtgaccgaggacttcaccggtaccatcgccgactcgatcaactattccgtggaccaactgcgcgacctggtggcgaccatcaacctcaccgccggccaggtcgctggcgcggtgcaggaaacccaggccaccgcgatgcaactggccgaagcctcggagcatcaggcccagcagatttccgaagcctccaccgcgatcaacgaaatggcccagtcgatcgatcaggtgtcggccaacgccgccgagtcctcggcggtggccgagcgttcggtggagatcgccaacaagggcaacgaggtggtgcacaacaccatccacggcatggacaacattcgcgagcagatccaggacaccgccaagcgcatcaagcgcctgggcgagtcgtcccaggaaattggcgacatcgtcagcctgatcgatgacattgccgaccagaccaatatcctcgccctcaacgcggcgatccaggcttccatggccggggatgccgggcgcggcttcgcggtggtggccgatgaggtgcagcgcctggcggaacgttcttcggcggcgacccggcagatcgagaccctggtgcgggcgatccagaccgacaccaacgaggcggtgatctccatggagcagaccacctcggaagtggtgcgcggcgcccggctggcgcaggatgccggggtggccctggaagaaatcgaaggcgtctccaagaccctggcggcgctgatccagagcatctccaacgccgcccagcagcagacgtcgtcggccggacagatatccttgaccatgaacgtgatccagcagattacttcacagacttcgtccggctcgaccgcgacggccgagagcatcggcaacctggcgaaaatggccagccagctgcggcgctcggtgtccggtttcaccttgccggccggtcgcgagcagacgccgcgggataaccgctgaggccggagcacgactttgatgggaatggtaatgggtgatcggcacgactatgtggccctggaatgggtcaagggcgaaattgccgaaacgctgaagcaggcccaccaggcgctcgatcatctggtcgacgagccgcaggcggtggaagcgctcgagcagtgcctggagtgcatccatcaggtccacggcagcctgcagatggtcgagttctatggtgcggcgctgctcgccgaagaaatggaagccctgaccctggccctgcgcgagtaccgcgtggcccagcgggacgaggcgatctacctgctgcgccaagccatcagccaattgccgcagtacctcgaccgggtgcaaagcgcgcgccgcgacctgccgctggtggtgttgccgctgctcaacgacctgcgcagcgcccgaggcgaaggcctgctgagcgaaaccagcctgttcagcccgcagctgccggacctgccggcgctggaccaggcgacactgaaccgcctggcgccccccgacctgaccatcctgctgcgcaagttgcggcacatgctgcaaaccgcgctggtcgacctgctgcgcgaacaggatgtgaaaaacagcctgggctatatggccaaggttttcgaacgcctccaggtgttgtgccagaacgccccgctggggcccttgtggcagatcgccctggccctggtggaaggcatgggcagcggggcgatcgccaacagcccggcggtgcgcagcctgctcaaggatgccgatcgcgaactcaagcgtctctatgaacaaggcatcgccgggatcaaccaggcggcccccgacgaactgctgaaaagcctgctgttttacatcgccaaggcccgctatcccaccgcgcagatgcagaccatgaaagacacctacggactcgatgacgctttgcccgacaatgcgctggtcgaccaggagcgggcccgcatggccggtcccgaccgcgacgccatgcgctcggtgctggcggccttgtgcgaggaattggtgcgggtcaaggaacgcctggacctgttcgtgcgcagcgaccgccagcacgcgtcggacctggacagcctgctggcgcccctgcggcagatcgccgacaccctggcggtgctgggtttcggccagccgcgcaaggtcatcatcgaccagctggcggtggtgctgagcctggcccagggccagcgcgaaccgaatgacgcggtgctgatggatgtggccggggccctgctgtatgtcgaggcgaccctggccggcatggtcggcccggccgaacccgagagccgcgaagaaagccgcctgccgaccaccgacctgacccagatccaccaactggtgatcaaggaggcgcggatctgcctgcaacaggccaaggacctgatcgtcgactatatcgatgccggttgggaccgcgaacacttgcaggccctgccggagctgctgacccaggtgcgcggcgcactggcgatgattcccctgggccgggcggcgggcctgctgcaagcctgcatcggcttcgtgcgcgaacacctgctgctggacccgcgccagcccggctggcagcagctggacaatctggccgacgtgatcaccagcatcgagtattacctggagcgcctgaacgacgatccccaggcgccgggggaaaagattctcgacgtggccgagcagggcctggccgcgctgggctatgcgccacaaaagcgggcgccggacgagtggctgccgaacgaacaggtgccgctgctcagcgatgtgctcagccccaacgaagccctggtgatgcaggacctgcaggagctggacaacccggaagtggcgcagtccctggccgatgtactggccagcccggtctcggcgctcaacccaccagcgctggacacgccgggcagcctgttgccgccgccgggcgatgaagcaccggtggacgatgagctgcgcgaagtcttcctcgaagagaccgacgaagtgctcgacgtgctgcgcgagtacctgccgcgctgggtcgccgagccccacggcaaggcggcgctgggcgaactgcgccgggccttccacaccctcaagggcagcgggcggatggtgcgtgcgctggtgctgggcgagttggcctgggccgtggagaacctgctcaaccgggtcctggaacacagcgtggagccggggccgcaggtgcggcaactgcttgaagaggtattgcagctgctgccggagctggtcgccgagttcgccgcccaggcccagcgccagcgcgacgatgtcgaccgcctggctgcccgggcgcatgccctggccaagggcgacgtggcgtcgccagacggcttggcagacgagctcgacccgcagttgctggagatcttccgcaacgaggccgaaacccatctggagagcatcaagcgctttctcgatcaggctgccgagcacctgccgctgcaggccagcgacgaattgcaacgcgccttgcacaccctcaagggcagcgcctacatggccggcgtgctgccgatcgccgagctggcggcgccgctggacctgctggcccgggaataccgcgcgcacctgatggccctggacctggacgaggtcgaactgctgctggaagccgaaggtctgtttcgccgcagcctgcaacagctgggcagcgatccgctggcgcccatcgaaggcgccgccgacctgatcgaacgggtcaaggcgctgaccgccgagcgcctggaaaccctgctcaacgcgcccaataccgggctgcgggtcaagcgcgatgcgcagttgatcagccgcttcctggcccagggcatggacatcctgctggatgccgaaaacctgctgcgccgctggcaacagcaccccggcgagcggcaggaactcagcgccctgctggacgagttgaccacccttggcgaaggcgcgcacctggcggatttgcagccgatggacgagctgtgcgaagcgctgctggacctgtacggcgccgtggaagaaagcagcctggcggtgggcgaacggtttttccatgaggcggaaaacgcccacgaagccctgatcaacatgctcgacgaactggccgccggccaggaaatcagcccgcaaccggccatggtccgggccttgcgcgaactgctcgaggaaagcctcgacccctcggccatgggcctgatccgcagcgacggcagccgcaccctgagcatcaccgagctggccagtgccaccgccgagatggagcagaaggcgcagatcgaggtggaggagccggacgatgaaatcgtagcgatcttcctcgaagaggcgatggatattctcgaaagcgccgaccaggccttgcagcgctggctggcggacccggacaacgttgcgccgctgtcttccctgcaacgcgacctgcacaccctcaagggcggtgcgcgcatggccgaagtcggcccggtgggcgacctggcccaggaactggaaaacctctacgaaggcctggtggatcgccgttaccagcatggcgaggccttggtcgatctgctgcaacgcagccatgcgcaactggcgctgctgttgcagcagttgcaggcgcagcaagcgctgagcgaccccaaggcgctgatcgaagcgattcgcggttttcgccagcgcagtggggccaccagcgaggtgcccgaggccgcggtgaccgacgattcggcggcccacgatccggagctgctggagattttcctcgaagaaggcttcgacatcctcgacagttcgggggcggcgctgacgcgctggcaggccgagccggccagccgccaggaagtggaaaccctgctgcgtgacctgcacaccctcaagggcggtgcgcgcatggtggagatcgtgccgatcggcgacctggcccatgaactggagtttctctatgaaggcctgtccgcgggcctgctgcaaccgaccccggcgctgttcggcctgttgcagaaaagccaggaccgcctggcgcagatgctcgacgccgcccgcgccgaacagccgatcaagccggccgacagcctgatcgaggcgattcgcggctttactcatccggcccaggccgaagcgccgcctctgttgctgcccgaccttagcccgccaagcaaacccgaaccgccagcggtaccggcggaagcggcggtggccggggatatggtcaaggtttcggccgagctgttggacgacctggtcaacctggccggggaaacctcgatcttccgcgggcgcatcgagcaacaggtcaacgatgcgcgggtggccctgagcgaaatggaaaccaccattgagcgtatccgtgaccagttgcgtcgcctggacaccgaaacccaggggcggattctcagccgccagcaggtcgaggccgagcgcctgggctacgaggaattcgacccgctggagatggaccgccattcgcagttgcagcaactgtcgcgggccttgttcgagtcggcgtccgacctgctcgacctcaaggaaaccctggaccggcgcaaccaggacgcggaaaacctgttgcagcagcaagggcgggtcaataccgaattgcaggaaggcctgatgcgcacgcgcatggtgccgttcgagcgcctggtgccgcgcctcaagcgcatcgtccgccaggtggccgaggagttgggcaaggacgtctcgttcagtgtcggcaacgccgagggcgagatggaccgcaatgtgctggagcgcatggtcgcgcccctggagcacatgctgcgcaacgccgtcgaccatggcctggagtccgccgaggtgcggcgcgcctcgggcaagccggagcaggggcggatcaccctggacctgtcccacgaaggcggcgatatcgttttcgacatgcgcgacgacggcgccggggtgccgctggaggcggtgcggcgcaaggcgatcaagcgtggcctgctcgcccccaatgccgagatcagcgaccgcgacgtgctgcaattcatcatgcagccggggttttccacggcggagaaaatcacccagatttccgggcgcggggtgggcatggacgtggtccatgaagaggtgcgccagctcggcggctcgatgaccatcgactcgatcccggggcagggcgtgcatttccgcatccgcctgccgttcaccctgtcggtcaaccgtgcgctgatggtgcagtgcctggaggagcagtatgcgatcccgctgaacaccatcgaaggcatcgtgcgggtgctgcccaacgaactggaaagccattaccagctcgacccgccccattacgtatacgccggccagcgttatgagctgtgctacctcggcgaactgctgcacaccgtggcccggccgaaactgctggggcagagcctgccgctgccggtactgctggtgcattacaacgaacaccggatcgccgtgcaggtggatgccatggccggcacccgggagatcgtggtcaagagcctggggccgcagttcgcggcggtgcaggggctgtccggcgcgaccatcctcggcgatggccgggtggtgctgatcctcgatctgctggcgcatatccgcgccctgcaaacgcgcttgccggtgccgcgcatggcggctggcgatgaagtgagcgtcgaggtcgaaccgctgcggccgaggctggtgctggtggtcgacgattcggtgacggtgcgcaaggtcaccagccgcctgctggaacgccatggcatgaacgtgctgaccgccaaggacggggtcgacgccatggcgctgttgcaggagcacaccccggatctgatgctgctggacatcgaaatgccgcgcatggacggcttcgaggtggcgatgcaggtgcgcgccgacccgcgcctgcaccagctgccgatcatcatgatcacctcgcgcaccgggcagaaacaccgcgaccgggccatggccatcggcgtcaacgactacctcggcaagccttaccaggagtcggtgctgctggagagcatcgcccagtggagcagaccccatgcatgactatcgcgccagcttcctcaccgggctgctgctgcccctggccgaccgtaccctgatcctgcccaacgtcgcggtggccgaattgatcgactatcaacgcggcgaaccggccagcgacgcgccaccctggtacctgcgctctgttgcctggcgcgaccgccagctgccgctgatcagcttcgaggccgcttgcggccagcccctggccattggcgagcgcgcgcgcatcgtcgtgctcaataccctgggcggtcgcgagcgtctgaagttcatcgccctggtgatccagggcatcccgcgctcctgccggctcgacagccagctgagctacgtcgacgtgccgctgtgccggctggaaaaggccgcggtacaggtgggggagcaggtggcgaagatcccggatttgttggggttggaggcgatgctggtggaagcggggctacatctgtagccgctgccgctgtaggagcggccggtcgacgctcgattgcccgcgatgacacccgtcctggcgctgcattttttggatggtgtacatatcccttcctgcggtaacggcggcttatggtttcgcccttacggcgagtccctttttacaaacgcctaaaaaggaaccaaaaacgcttgctggtatgactcacccacataggtaacagaaaagttcaagcacataggtaacagtttttaactggcagggtcgattccgaggagctgaccatgccgtggcgagagctgaaccctatggaccttaaagtgatgttcattgccgactatctgtcgagacgctttaacttccgcgaactgtgtgcggcacacagcatcagtcgaaaaacgggctacaaatgggtagcccgttacaacgcagagggtgtgcagggcttggatgagcgcagtcgcagtcggcatgctcaggcacatatcattccctttgaaatcaaagcctcgatcatcgagttgcgctccaaaggacctacgacaccgggccccaagaagatccaggtggctttggctgagcgttttccagggcaggagccgccctctaaaaccagcatctacaacatcctcaagcgggctggtttgataacgccaagacgcctgcgtcagcgtgttgcaatctacccaattccgttgaagagagcggacctccccaatcagctatggagcgctgactacaaagggcaatacctgacaggagaaggcgtctggtgttaccccttgagggtcatggaccatgcgagccgttttctgttggcctgcgagagcatgcccagcaccaacttcaaagacgcccaaaaaacgttcgaacggttgttcaaaacctatgggatgcccgaacgcattcgcactgacaatggtgttcctttcgccagtgcggggcgtgcggggttgtcgctgttgtcaatttggtggctacgtctgggcatcattcccgagcgaatccaaccgggtcgacccgagcaaaatggtcgtcatgaacgcatgcaccgcacgctgaaaagcacgctggtcagtcctccggaaattgaatggggcgctcagcaaaagcactttgatctgttccagcagcactacaatcatgaacgaccgcatgaggcgcttgggcagagaacaccggcctcctgttattgctgttcggatcgaacttatccggcacggctaccagtgatgaggtatcccagccatatagaaacctatgtcgttgactcttgtgggatcgtcaacagaggtcggctcaggatctatgtcggcaatgtgctcaagcgcgaaacggtaggtctggagcgtatcagtgagggtatttgggacgtcatatttggcccgatcaagttgggtcgctttgatttgaaagatgcccaggacggttacatcaggctcagtccggcgtcataggcctgatttggtgttacctatgtgcctgaacttttctgttacctatgtggttgtcccgttcatgcccctgcgtacggccttcgctgcgctcaggttccctcgctccggcgtccatcagggggcatcgactccggtcggcttcgcttcgacctccatacgatgtcctcgactgcgtcgaggggcgctgcgcgccatccccctgatgaacacctccactcggcctcccgatggggcgggtagatcaagatcaaaagccaaagctgcgccatgcgcgacctaccggtcggcgctaactcctgtagccgctgccgagcccgcgaggctgcgatcgaccccgcagggggcgcagggattttgaaaccgctggaggacctgcggtcctatcgcagcctgcggcagcggctacaggtttggggaggtatcaggggagagtggggcagatctggttttgctgaaggcaatggcaacacattgcgggttgtcgctggttttttgcatagccatagtgggtttgccgccgacgcatcggtggccgatcttagccggtcgaaactgttcacggacgcacaagcgccctcctataatgctggcgctttttgctgcctgcatttgctatggcggctgtgcgtgggacacctgcgggtgtgccggacttccgtgaatggtccggtcggctaacccgcgtacagctgccaccctctttgtttagccgcatagggtggtaactcttcagcattcacggagaaatacccatgactgagttcaccccgctacacagcaatctcaccactacccccgtgctttacctcaaccccaacgccccggcatccgacctgcacggttgtgccgtccagcgcgtcaaggccacccgcgacctgatgcacagcctcaactgcctgagcctcaagggtgttcacgaccaggacctgcgccatatcgtcaatgcggcccatctgctgttgcaggatggctgcgatgtgctggatgcgttgcagtggcggctcgaaggttaagcgcaaggttgtttatggggcgtaggtgtgaaggcctgcgcccttgatcattaccctcaccgtaacgatccaccactctgcttgattgatgccatgcctcctgcgctcctaaggtagcggccatgacagcgaacccgtggagtgagcatgacaacaacaatatcccccgactcgcgctggacgcggcggcgcgctgaaaagcagcggcgtctcgagcaggtgcggggtctcgccgatggcgccgtgttgcccaccgacaagatagtcgcggcgctggaggcgttgattctgcctggcgaccgcgtggtgctggagggcaacaaccagaagcaggcggacttcctgtcgcgctccctggccaaggccgacccgagccgcctgcacgacctgcacatgatcatgcccagcgtcggccgctcggagcacctggacctgttcgaacgcggcatcgcccgcaagctcgacttctccttcgccggcacccagagcctgcgcatcagccaactgctggaagacggcctgctggaaatcggcgcgatccatacctacatcgaactctatgcgcggctggtggtggacctgatccccaacgtggtgctctcggccgggttcatggccgaccgcgcgggcaatatctataccgggccgagcaccgaggacaccccggcgctgatcgagccggcggccttcagcgatggcatcgtcatcgtccaggtcaaccagctggtggacgacgtcagcgagttgccgcgggtggatatcccggcctcctgggtcgacttcgtggtggtggccgacaagccgttctacatcgaaccgctgttcacccgcgacccgcgccacatcaagccggtgcatgtgctgatggcgatgatggcgatccgcggcatctatgaaaaacacaaggtccagtcgctgaaccatggcatcggcttcaacaccgcggccatcgagctgatcctgccgacctacggcgagtccctgggcctgaaaggcaagatctgccgcaactggaccctcaacccgcacccgaccctgatcccggccatcgaaagcggctgggtgcaaagcgtgcattgcttcggcaccgaactgggcatggaaaactacatcgccgcgcggccggatgtgttcttcaccgggcgcgacggttcgttgcgctccaaccggatgttctgccaactggccgggcagtacgcggtggatctgtttatcggcgcgaccctgcaggtcgatggcgacggccattcctccaccgtgacccgcggccgcctggccggcttcggcggtgcgccgaacatgggccacgacccccgtggccggcgccacggcaccccggcctggctggatatgcgccacgacgactcgcaacagccgatgctggagcgaggcaagaagctggtggtgcagatggtcgagaccttccaggaaggcggcaaaccgaccttcgtcgaaaccctcgacgccgtggaagtggcgaagaaaagcggcatgcccctggcgccgatcatgatctatggcgacgacgtcacccacctgctgaccgaggagggcatcgcctacctgtacaaggcgcgttccctggaagagcgccaggcgatgatcgcggcggtggccggggtgaccgccatcggcctgcgccacaacccgaaagacaccgcgcgcatgcgccgccaaggcctgatcgccttgcccgaagacctcggtatccgccgcaccgacgccagccgcgagctgctggcggcgaaaagcgtcgccgatctggtggagtggtcgggtggcctgtacaacccgcccgccaagttcaggagctggtaaatgcacgccttcaacctgcaaagcaaacccctgagcctggccgagcgcctggcggacctggcggtggacgcgctgatcgacgaggccgacctgtcgccgaagccggccctggtcgaccgtcgcggcaacggcgcccatagcgatctgcacctggggctgatgcatgcctcggcgctgtcgctgtggccagccttcaaggaaatgggcgatgccgccagcacgttcggcacggtcggcctgcccctgcgcgaagccctgggccgcattggccgtgaaggcgaagcggcgatgctcgctacgactcacggggtgaacactcatcgtggcgcgatctgggccctgggcctgctggtggccgccgccgcgctgggacctcaggccaacacggcaggcgccctgtgcctgcgggccgcgcgcctggcgttgctggacgaccgttacgcgccacggcccctcagccacggcgcgcaagtggcgctgcgctatggcgtgcgtggcgctcgggaagaagcccagttgggttttccggcggtgctgcaacggggcctgccgcaactcgaacgcagccgtgcccaggggcatggcgaacagaacgcccggctcgatgcgctgctggcgatcatgaccggcctggccgacacctgcgttttgtatcgcgccggtgaggaaggcctgcgggccatgcaacagggggcccaggcggtgctcgacgccggcggcagcgccagcctggccgggcgtcgccgcctgcatgagctggaccagtgcctgctggccttgaatgcctcgcccggtggcgccgcggacttgctcgcggcctgcctgctgatcgaccggatcgcctccggcgccgcctttatccagggagcagtgtgatggaaaccttgtctttcgaatttcccgccgggcaacccgcccggggccgggcgctggtgggctgtgtcggctcgggcgacctggaggtgctgctcgaacccgggcagcccggcaagctgagcattcaggtgcagacctcggtcaacggcagcgcgtcgcgctggcagcatctgttcgagcgcatgttcgacggccagacgccgccggccctgagcatcgacatccatgatttcggcgccaccccgggcgtggtacgtctgcgcctggagcagggcttcgaggagattggccatgactgacagcgcccgtttgctcaacaaacacagcttcgtcgaactcggtgcccggcagcgggccaaggccctgctcgacgccggcagctttcgtgagttgcttgatccgttccagcgcgtgatgtcgccgtggctggcgcgccagggcgtggtgccccaggccgatgacggcgtggtgattgccaagggccgcatcgacggcctgccggtggtgatcgccgccatcgaaggcgcgttccagggcggcagcctcggcgaggtcggcggggcgaagatcgccggcgccctggagctggcggccgaagacaaccgcaagggcattgctacccgcgccgtactgctgctggaaaccggcggcgtgcgcctacaggaagccaacctcgggctggcggcgattgccgacattcacgcggccatcgtcgacctgcgccagtaccagccggtgatagggatcgtggccggcagcgtcggctgttttggcggcatgtcgattgccgccgggctgtgcagctacctgctggtgacccaggaggcgcgcctgggcctcaacggcccgcaggtgatcgagcaggaagccggcctcgaggaatacgactcccgcgaccggccctttatctggagcctgaccggcggcgagcagcgtttcgccagcggcctggcggaccgctatgtggccgacgacgtggcgcagatccgccaacagctcggcgagctgctggcccagggcctgcccagcgcacaacgcagccgtcaggccgagctgtacctgcaacgcctggcccggctggatagccatccacagatcgacccggcgacggttcgccagctgtatcgaggagaccgctcatgagtgcttattccctgcggggcctgcattggttcacgaacctgagcgcgggtgccgccccggtagcgggtttgccggcctcgttgaaggtggcggacgccacgctggagcagcaaccggtgcggtttatcgccgtggtcgccgacccggccaacccttttgtgcgggcgcgtaatggtgaggtcggcctgctggaaggctggggcctggccaaggcggtggacgaagcgatcgaggccgaccgcgagcagagcctcaagcgcgcgctgatcgccatagtcgacgtgccgagccaggcctatgggcgtcgcgaagaggccctgggcatccatcaggccctggccgcggccgccgacagctatgcccgggcccggctggccgggcatccggtgatcggcctgctggtgggcaaggccatgtccggggccttcctggcccacggttaccaggccaaccgcctgatcgccctgcgcgacccgggggtgatggtgcacgccatgggcaaggtctcggcggcgcgggtcaccctgcgcagcgtcgaggaactggaggccctggccgccagcgtgccgcccatggcctatgacatcgacagctatgccagcctcggcctgctctgggagacattgtcggtcagccagatcgaacagccgaccgccgacgacctgactcaggtgcggcaatgcctgggccaggcgattgccgatgtgcgggcccatggccgcgatctgtcgggacgcctgggcgccactaaccgtggcgcctccagccgggtccgccagctgttgcgcgagcaatggtgagcgccatgaccagcgccttgctgccccatgacctgctgtggggcctgtcccctcggcaactgcccgccgatgccccggcctgggcggtggcggccatggccgccgggcaaccggtggtggtgcgccgtgcgttgacgcgcccgggcaggtggcggtgggcgtgcgtgggcggctgcgggaacagcgctacgggacgctgatggcggtggcggccatcgagcgccgggtgcggccggaagcgctgtgccatgtcgagtcggatcgtgtctggccagcgctccaggcactggctcggttgcgtgaacccctggatgccctcggcctggcctggggtgtcagcggcagcgccggttttgaactggccagcggcgtgccggcgctgcatcggcacagcgacctggacctgatcctgcgcactgcgcagcccatggaccgggccgaggcccgagcgttgctggcgctgctcgatggcgccgtctgcccggtggacctgcaattgcagacgcccaacggcgccgtggccctgcgtgaatgggccgggacatcggcgcgggtgctgctgaaaagcgccagcggcgcgcgtctggtcagcgatccgtggcaggccctggagcaggtggcgtgagcagtctgctggtgtttccaggccagggcgcgcagcagccgggaatgttgcatcgcctgccgcccagcgccctggcggacgcctgcctgcaacaggcgagcgaggtcctgggcgaggatgccctggccctggattcgccccaggccctggcgactacccgggtggtgcagctgtgcctgctgatcgccggcgtggcccatgcccgggtgttgctggaaaacgggccgggcgcggattacgtggcgggtttgtcgattggtgcctaccccgcggcggtgctggccggcgccctggatttcggcgatgcgctgcgtctggtcagcctgcgcggcgagctgatgcagcaggcctatccgcagggttatggcatgaccgcgatcatcggcctggaactggtgacggtggaggccttgctggcccgggtgcacagcccggccaacccggtgtacctggccaatatcaatgccgatagccaggtggtgatcgccggcagcgatgccgccatggcccaggtcgccgagctggcccggggctgtggtgtcggggtggccaagcgcctggcggtcagcgtgccgtcccattgcccgctgctggagcagccggcccaggccctggccgaggcgttcgccagggtggcgttgcagccgccgcgcctgggttacctgagcggcagccgcgcgcggccgctacgcacgccggagcagttgcgcgacgacctggcgttcaacatgtgccgggtggtggattggcgcggcaccgtgcaaagcgcctacgagcgcggcgtgcggctgcagatcgaactgccgcccggcgcggtgctgaccgctctggcgcgccgggtgttcgagcagggcaccgtgatggcctgcgacggtgcccggctcgacaccttgcaagcgctgttgcgtgaggagggaaaccgccaaccctagacaccgactcaagctggcgaagcacaagaacaacaacttcgacgatgcactctgaggactacaacaatgattatttacggtgtggcgctgctggcgatctgtacgctggcaggggtgattatcggtgacatgctcggcgtcctgctgggggtgaaatccaacgtcggcggggttggcatcgccatgatcctgctgatttgcgcgcggctgtggatgcacaggcacggcggcatgaccaaggactgcgagatgggcgtcggcttctggggcgccatgtacatcccggtggtggtggccatggccgcacaacagaacgtggtgaccgccctgcacggcggcccggtggcggtgttggcggccatcggctcggtgctgctctgtggctgcaccatcgccctgatcagccgcaccaacaaaggcgagccgttgccggacgaaccggacagtgtcgcccctggcgccgctgcggcagggggacgctgatatgtgggatctgatcgagaaaggcctggaacacaacggcctggtcaccgccttcgccttcgtcggcgtgatcatgtgggtctcggtgctgctgtccaagcgcctgacattcggccgggtacacggctcggccatcgccatcgtcatcggcctggtgctggcctgggttggcggcaccatcaccggtgggcaaaagggcctggcggacctggcgctgttctccggcatcggcctgatgggcggcgccatgctgcgcgacttcgcgattgtcgccacggccttcgaggtccaggccaccgaagcacgcaaggctgggatgatcggcgccatcgcgctgtttctcggcacggtgctgccgttcattgtcggcgcgagcatcgcatgggccttcggctatcgcgatgcggtgagcatgaccaccatcggcgccggcgcggtgacctacattgtcggcccggtgaccggggcggcgatcggcgccagttccgatgtggtggcgctgtccatcgccacggggctgatcaaggcgatcctggtgatggttggcacgcccatggcggcgcgctggatgggcctggacaacccgcgttcggcgatggtcttcggcggcctggccggcaccgtcagcggggtgaccgcgggcctggcggcgaccgaccggcgcctggtgccctatggcgcgctgaccgcgaccttccataccgggctgggttgcctgctggggccttcgttgctgtatttcatcgtgcgcgggttggtggggtagggcggctggccttatcgcgagcaagctcgctcctacaggtctctgtaggagcgagcttgctcgcgatagcgttcgtgtaaacaccgcgctttatgtgtcttgccgattggcatacatccggcactcggccagcagcgccagcaggttcgggtcgcgctccttggccttgaggaacaccacgccgatatgctgttgcagccggtagcgcgcctgcagcggaatcagcttcacgcggttttcgtacaccgcggcaatccttcccggcagcagggcatagcccacccccgagctgaccatgctcagcagggtgaagatgtcgttgacctgcatcgccaccttcggctcgaaccccgcctgcttgaacacccgcaccccgtcctgatgggtggcgaagccctgggtcagggtgatgaaggtcgcatcgcgcacatcgctgaggtcgacttccgcctgctgggcgaacggcgagtcggccggcgtggcgaggaagatatcgtcggaaaacagcgggatctgctcgcagtccgggtcgctgacgctgtcgtccagggacaccaggatcgcgtcgacctccatgttcttcagcttgtacagcaggtcgatgttggagcccaggatcaggtcgatattcagctcgctacggcgcagcttcaggcccatgatcagctgcggcacggtcttcaccgtcaatgaatacaacgagccgagcttgaagcgctccgccgagaacccggcggcttcgcgggtcaggcgcacgctttcgaccacgtcctggatcagcttctgcgcccgttcttcgaggacgaaggcgctttccagcggtgtcaggttacgtccttcatgcttgaacagcgggcagcgcagggcgctttccagggagtgaatggcccggtgcacgctgacattgctggtctgcaactcggcggcggcgcgcgccaggttgccggtgcgcatgaacgccagaaacacttcgagctttttcagggtcaactcttcatcgatcagcatgatgggcgctcttattcgaatgctccgattgtgcctgccgggtcatgacttggctggaggttttttcgtccatagctttattcggaaacattgcgctttcaggctacaggcctgagccttgcgcagattttcgccttgggaggtgagtggcacatgtatcacggggaaagactcaacgcctggacgcatctggtgggcgcgattgcggcactggtcggggggatctggctgctggtgttggccagcctcgacggcagcccttggaaaatcgtcagcgtggcgatctacggcttcaccttgctggtgctgtacagcgcctcgaccgtgtaccacagcgtgcgcgggcgggcgaaaagcatcatgcagaaggtcgatcatttctccatctacctgctgatcgccggcagctatacgccgttctgcctggtgaccctgcgcgggccctggggctggacgctgttcgggatcgtctgggggttggcgctgatcggcatcctgcaggagatcaagccgcgctccgaggcgcgcatcctgtcgatcgtgatctacgcggtgatgggctggatcgtgctggtggcggtcaagccgctgctggcggccctgggccccgccggcttcgcctggctggcctcgggcggggtgctctacaccgtgggcatcattttcttcgccctcgacagccgtttgcgccatgcccacgggatctggcacctgttcgtgatcgccggcagcctgctgcacttcgtggcgattttcttctacgtgctctgatcggcgagcgcgttatcgtttatcgcgagcaagctcgctcctacaacgggtagcgtacatccctgtaggagcgagcttgctcgcgatgacgtcctgacaggtgtcctcaatccccggtcatcaaccgatccaactgctcctgcgcgcggccgccgaaaatctccagcaggctgctcaaggtgtgcggcagcgcctccgccgcgcgggtcacggcatacagggtgatcggcagcgccggggtcagcgggcggatcgcggtgctggcgggcgaggcgccgagggcggtgaaggggtcgatcaccgccagcccggcgccggattcgaccatggcccgggccagggagtaggtctgcacggcaatactgacccgcggcgccggttccacggctttcaggtaaccgtcgagtttcgccgccagcgggtcggcgctggacaggccgatcaagggcgcccccgccagctccatcagcggcagcggcgtgcccctggccgcctggggccagtaatccagcggcgccagcgccaccagcaccccgctggccagggcctgggcggtcagccccggatgatccgggcgttgcagggtcagggccacatcgatctcgcgcatcagcaggttctgcaccagctcgcggctgtgggcgctggacagctcgcagacgatgtccgggtagcgccgggtccactggttgatggccggcggcaacaaggacagggccagcgccggcgtggcgccgatccgcaggctgtggcccggctcgcggcgcaggctctgggccaggcgccgcaccccttgcaggctttcgctgaccttgtcgacctcgtgctccagctccagggcttccggggtggcctgcaacttgcccttgacccgcaggaacagcgggaagcccagctgctgctcggcatgctgcaagaccttggtcaccgccggctgggagacgtgcagcagttgcgccgcgccgctgatcgagccggtctggcggatggcctggaaaatctcgatatgacgcagccgcatgatgagtccataacctttgtttatgggtggtccatctttattcattgtcccgggcctgtcacctggtcctaacctgaagcccgctcaacaaggctttaaggactgacatggcacagcgggtttgcatcatcggcggcggggtcattggcctggccagcgcctacgccctggttcgcgaggggttcgacgtcagcctggtggaggcgcgcgacgccttcgccagccagaccagcttcgccaacggcggccagctgtcgtaccgctacgtggcgccgctggccgatgccggcgtgccctggcaggcgttgggctggatgctgcgtggcgactcgccgctgaagctgcgcctgcgcctggacccggcgcagtggcgttggatggccgggttcctggcggcctgccgcggctcggtcaaccgccgcaacggcgcccatctgctgcgcctggcgctgctgagccaggccaccttgcagagctggcgcgacgaggaccggctcgacggttttcactggcggcgcaacggcaagctggtgaccttccgtgaaaccgccagtttcgagcacgcccgccacggcctggccgatcccggccagcagcaggtgctgtccgctggcgaatgcgcgcaactggagccaaccctcggcggcgcgccctttgtcggcggcatcttcaccccggacgaagaagtggccgactgtcacgccttctgccagcaactggtggagcggctacaggcttccggccgttgccagctgctgaccgggcgcccggtcaccggcattcgccaggtgggcggccaggtgcaggccatcgagctgggcgacgaggtgctggcggtggatcaactgatactcgccgccggtcatcgcagtggcgaactggcgttgcccgggctgaagctgccgctgtatccgctcaagggctacagcctcagcgtgccgatcggcgcggggcaccgggcaccggaaatcagcatcaccgattacaaccgcaagatcgtctacgcgcggatcggccagcagctgcgagtggcggccatggtcgatatcgtcggtttcgacccggccctggaccccaggcgcctggccctgatgcagcgccaggcccgggaaaccttcgccaacgccggcgactacgatgccgccatcgagtgggccggcatgcgcccggcgacccccagcggcgtaccgctgattggcgccaccggctaccgcaacctgtggctcaacctcggccatggcgccctgggtttcaccctggcctgtggcagcgggcgcctgctggccgagctgatcggccagcgccgcacttccatcgacatgcaggggctcgcgccccatgccgcctgatttctttcgcatacaaggagctgtcccatgaccatccagcgtctccacagcaatgaccgcctcagcgctgtcgcgggttttgccgatctgctgttcctgtccggccaggtgccgggtccggccaccgatgccgccggccagacccgcgaagtgctggcgaagatcgacgccttgctggccgaggccggcagcgacaaggatcatctgctcagtgcgaccctctacctgaaagacatccagcgggactttgccgcgatgaacgaggtctggtcggcctggttgtccccgggccaggcgccaagccgcaccacggtgcaggccgccctggcgcgtccggacatcttggtggaaatcactgtcatcgcggttcgccgctaacgccttcacccacaacggagaataacaatgcaaaaaatcacgttgctcggctgcaccctgggcctgttgcttggctccccgctgtacgccagcgaggcgccgctgaccggcaccctgggcaagatcgccactgccggcagtattaccctgggttatcgcgatgcctcggtgccgttttcctacgtgggtgacaacagcggcaaacccatgggctactcggtggacctggcgagcaaggtcgtcgagcgcatccgcgacaagctggcgctgccgcaactggcggtgaagtacaacctggtgacgtcgcagacgcgcattccgctggtgcagaacggcaccgtggacctggaatgcggctccaccggggtgaccgccgaacggcagaagcaggtggcgttttcctacggcttcatctacgtcaagggccagttgctgacggccagagacagcgggatcaagagttttgccgacctgcgtggcaagaacgtggtgaccaccgccggcaccaccaacgagcgcttcctcaagagctacaacgtcgagcacaagatcgacatgttcgtgatcagcgccaaggaccacggcgaagccttccagatgttgcaatcaggtcgcgccgcggcgttctacatggacgacgcactgctctacggcgaacgggccaaggcccgcgatccgcacaactgggtggtggtcggcgaagagcagtcgcgggaaatctacagctgcatggtgcgcaaggacgatccgcagttcctggagctggtaaacgccaccctggcggacctgtaccgctcaggggaaatcaacgggatctaccagcgctggttcgaacagccgattccgcccaagggcctgaacctggaattcccgatgaccagcgagttgaaggcgatcatcgccaagccggtgagcgatccggtggagtgatcggcccctctgtaggagcgagctcgctcgcgattggatcggccgagcgtggaaattgcgttggctgatcccgtttttcgcgagcaagttcactcctacagaaggggttagaagtcgccccagagttgctgggccacggccagcgctaccactggcgcggtttcggtgcgcagcacccgcggcccgaggcgcgccggcaggaagcccgcgtcctgggcctggtccacttcggcatcggacaaaccgccttccgggccgatcaggaatgccagggtcgcaggcttggcatggcttaccagcggctcggccaccgggtgcagcaccagcttgaggtcggcctgggtctgcttgatccagtcggccagcagcaccggcggatgaatcaccggcacccgtgagcgcccgcattgttcgcaggcgctgacggccacctggcgccagtgggccaggcgtttgtcggcgcgctcgtccttgagccgcacctcgcagcgctcgctgaagatcggggtgatttcattcacccccagttcagtggccttctgaatcgcccagtccatgcgctcaccccgggacaggccctggccgaggtggatctgcagcggcgactcgacctgcccggcaaaactttcatcgagccggaccaccacgcgcttcttgccgacttccagcagcgtgccgcgaaattcgttgcccgaaccgtcgaacagctgcagcgcgtcgccctcggccatgcgcagtacgcgcccgatgtagtgggcctgggcttccggcagctcgtgctcgccgaggctcaggggggcgtcgataaagaagcgggacagtctcatggtggttctctgggaaaattcggttcgagatgggtcaatggatctttgcgtcggcaagcccgcttctgcaaaacggcgggcttgccggcgaggggctcaacccggatcgcggaagcctgggtggaagtccttgggcaccgccacgctgaccttgtcgctggtggcgatatcgataccttcgctggcgacttcggcgaggaagtcgatctgttccggagtgatcacatagggcggcaggaaatacaccacgctgcccagcggacgcagcagggcgccacgctccagggcatgctggaagactttcaggccacgacgttcctgccacgggtaggcggtcttgctggccttgtcctggaccatctcgatggccagcaccatgccggtctggcgcacttcggcaacgtgcgggtgatccgccaggtgcgcggtcgagctggccatgcgctgggccagagcccggttgttctcgatgacgttgtcttgctcgaagatatccagggtcgccagcgccgccgcacaggccagcgggttgccggtgtagctgtgggagtggaggaaggcgcgcagggtcgggtagtcgtcgtagaaggcgctatagacgtcgtcggtggtcaggcacgcggccagcggcaggtagccgccagtcagggccttggacaggcagaggaagtccgggcggatgccggcctgttcgcaggcgaacatcgtgccggtacgaccgaagccgacggcgatctcatcatggatcaggtgcacgccgtagcggtcgcaggcctcgcgcagcagcttgaggtacaccgggtggtacatgcgcatgccgccggcgccctggatcagcggctcgactatcactgcggcgagggtggcgtggtgttccgccagggtctgttccatggccgcgaacatgttgcgcgagtgttcttcccagctcatgccttcggggcgcaggtagcagtccgggcttggcaccttgatagtgtccagtagcagggccttgtaggtctcggtgaacagcggcacgtcgcccaccgacatcgcggcgatggtttcgccgtggtagctgttggtcagggtgacgaagcgcttcttgtccttctggccgcggttgaaccagtagtggaagctcatcttcatcgccacttcgatgcacgacgagccgttgtcggcatagaagcagcgggtcaggccttcgggagtcattttcaccaggcgctcggacagctcgatcactggctgatggctgaagccggcgaggatcacgtgctccagctgatcgacctgatccttgatgcgctggttgatgcgtgggttggcgtggccgaatacgttgacccaccaggaactgaccgcgtcgaggtagcgcttgccttcgaagtcctccagccacacgccttcgccgcgcttgatcgggatcagcggcagctgctcgtggtctttcatctgggtgcagggatgccataacaccgcgagatcgcgttgcatccactggttgttgaggcccatgttcagtctcctggaggcggctctaagtacgcgagcaaacaatcgcgcaagcctatgcaatgccaggccgtgtcacaacccattgcatgcctggaagggcgaattgatcgcggtcgcagaacggtctgtcacgttttccccacgtagaccttaatgcctggttaatttagtgttcgtaggatcaacatcgtatttctcgatatttcaaagcgaaaatttccgctttaattcgatagttaaatcgatagtcttgggcagcagttcttacaggatttaagtaatgcagctaggtaactcttcttcccgctacggctgggtaagcatttttctgcactggagcgtggcgctggcagtctttggattgttcgccctgggcctgtggatggtcggcctggattactacagtgcctggcgtaaagatgcgccggacctgcacaagagcattggcttgacgttgttcgcgatcatgttgctgcgggtgctgtggcgctttgtcagcccgccgccaccggcaccggccaaccacgggcgcctgacgcgcctgggcgccaagtttggccatgccttcctttatctcagtctgttcgctgtgatgattgccggttacctgatttccaccgcagacggtgtcgggattccggtgtttggcctgtttgaagtacctgccctggtttccggactgccggaccaggcagatgtggccggcgaggtgcatctgtacctggcctgggccctggtgatcttcgccggagtgcatgctctggctgccttgaaacaccactttatcgatcgtgacacgaccctggctcgtatgctggggcgcaaagcctgatgctcaacctcgactcaaaaggaatagaaagcatgttgaaaaagactctcgccgctctggcaatcggttctgctctgttgtctgccggtcaggcgatggccgcggactacgtgatcgacaaggaaggccagcacgccttcgtcgacttcaagatcagccacctgggctacagcttcatcaccggtactttcaaggacctggacggcaagttcagcttcgacgcggccaagcctgaagacgccaagatcgaagtcaacgtgcgcaccgccagcgtgttcaccaaccacgccgagcgtgacaagcacgtcaacagcaaggacttcctggagtcgggcaaattccctgatgcgaagttcgtttccaccagcgtcaagccaaccggcaagaatgctgatggcaagcagaccgccgatgtggctggcgacctgactttccacggtgtgaccaagcctatcgtggtcaaggccaccttcctgggtgaaggcaaggatccatggggcggctaccgtgccggttttgaaggcaccaccagcatcagccgcaaagagttcaacaaggacgggatggatgttggcccgcagtccgataccgttcagctgtacatcaccttcgaaggtgtgaaagcgaagtaatgcttcgcctgtagccgctgccgagcccgcgaggctgcgacaaggtccgcaggaccttcatggcctgcgaccggttcccgctcgatcgcagccttgcaggctcgggagcggctacagagatcataaaaaaacgcccctgatcgcgagatcaggggcgttttttattgtcgcgaaaacttcagcgattgcgggtcagcaaggctggtttctcgccacgtggacggcttggcagttgatcgagctgctcgggtgtcgggaagcggtcggctttcgattccttgtgcatgatcttcggctggttgccgcgcgggttctgcaccgccggctcctgacgcgcctggtcgtcacgggccggacgacgattgcgcgactcttcgcgacgggcctggccgtcacgtggagcgccgctgcgtgggccgttgcgcttggcaggcggggtgccggtggtggcaccgttgctggtgcgcggaccgccggagcgaccctggccgccgctgcgtggcgcgttgctgctggttgcaccctgggctggcgcgccaggacgacggccgcggccctggttgttcttgttctggtacgggctgacgtagtcggcgcgattgccgaagttgtccacgtcgtcgtccaggaactcatccggggcgcggtccgcgcgtggcgtcggctggcgctgttcgcgggccggggtgccttcgcgaggcttctgctcacgggccgggcggtcgccgcgagcggccggtttgtccttgcccttgtccttgcctttgtctttgcggccgccaccaccaccgccgccattcggaccgtcgccacgcgggccacgggaattgcgcgggttacgcacgtccggacgctcgcgcacttccggcttctcggcttccacggcgctggcatcgaagcccatcagatcgccgtcggggatcttttgcttggtcatgcgctcgatgctcttgagcagcttctcttcgtccggcgcgaccagcgagatcgcttcgcccgaacgaccggcgcggccggtacggccgatacggtgcacgtagtcttcgtcgacgttcggcagctcgaagttgaccacgtgtggcagctggtcgatgtccaggccacgggcggcgatatcggtggcgaccaggatccgcacttcaccggccttgaagtcggccagggccttggttcgggcgttctggctcttgttgccgtggatggcgacggcggtcaggccgtgcttgtccaggtactcggccaggcggttggcgccgtgcttggtgcgggtgaagaccagcacctgttcccaggcgccggcggtgatcaggtgggccagcaaggcgcgcttgtggctggcggccaggcggaacacccgttgctcgatacgctcgaccgtggtgttcggcggcgtgacttcgatgcgttccgggttgtgcagcagcttgccggccaggtccgtgatgtccttggagaaggtcgcggagaacagcaggttctggcgcttggcgggcaggcgcgcgaggactttcttcacgtcatggacaaagcccatgtcgagcatgcggtcggcttcgtcgagcacgaggatttccacgtgggacaggtcgacactgccctggccggccaggtcgagcaggcggccggggcaggccaccagtacatcgacgccacgggccatggcctgaacctgtgggttcatgccgacgccgccgaagatgcaggcactgacgaacttcaggtcgcgggcatagaccttgaagctctcgtgcacttgcgcggccagttcgcgggtcggggtcaggaccagtacgcgcggttggcgcgggccgtgacgctgggatttgtccgggtgaccgttgggaaacaaccgttccaggatcggaagggcgaaaccgccggttttaccagtacctgtctgtgccgcaaccatcaggtcgcgaccttgcaacacggcgggaatggcccgctgttgcaccggagtaggctgggtgtagccggcggcttcgatggcgccgactaaagcctcggagagaccgagggaagcaaaggacatgagtaatcctgttttagtgagggcttggcccagagggatagtcttgcctggcgcgaatggcgtttaagaggacgcaatcccgtccggtcctgctggctcctgaaggctcatcggcgagggctcgcgcgggccttgtggctgcgctgtagcggtatcgagatgccttgaacaggatcgagcgtccgggcgtgagcctggcgggaaggccggagtataacagagcaatcagcgtgcgctgctttcctgctgctcaacggttttgcgcggtgtgccgggcggcattgcgcttgagtcggcgatggccggcgccgcgccatagcgggcgctcagttcggcgtaggccggctcgcgcttgaagcgcttgagttcggcgccgaaacgctgcaccagcaagtccatgccggcattgcgccgcacggccagaaactggctctggcggctgatgaccaccgggttctcggtgatctgctggcgaatgttcagttggtcgagcagatgctggccgacccgccgatcggtgatcagcaggtcgatgcggccgcgcagcagcttgccgaagttggcttcgtgggtcggtgccggttcgtgcttgaacagggtggattccctgaagtcctggctgtacaggtagccgggggaggtgcccacggtcagcccgcgcaagtcttccagggagtggaacggaaagggccgggcgttggcatagaacatcacgaactcgacgtccgacagcggctcgctggggtagagcaggctgctttcgcgttcgttgctatgaaagatgtccagggcaccgtcggcctggccttgttcgagcatggccaggcaacgtttccagggcaggaactgccattcgacttcgatccccaggcgctggaagacgatcgccgtggtttcgtaatccaggccctgggccttgccctgttcctcatagacataaggggcccagggctcggtgacaatgcgcagcttctcgccatgggcggtgaggctcaggcaagcgcagataaaggcggtcagcagctgggcaatgacgggcatcgctggagattacgacgacaggtcgtccaatgctagaggccgtctagctcaagcctcagtcagcctttgtctcgatcagatgcaggtagatggccttgcgccgctggcccagtaccaggcgaattaccgggtggttgaaccagcgctcgagttgatggctgttgagcggttttttcaggcggccttcggcgttttcccgggctttctcccaccagaccggcgcgcaggcctggtcgaattcgttggtgtggcggtagcagccgtagaggatttcgcgcatgaactgccgctggtgcccgggcagggccagggtcacgatcttgtaggccaggcgttgcaaggccggcgggcgtggcagggtcgcggtgaccaggcgggtttcgtccagggcgacgctgctggtgggcgctgcgatgtgcttgtccagccaggccttgatcttggcgcgaaacagctgcttgcggctccagtaatggtggatcaggtcggggcattcgcgaacctgtttggtgcgataggccgccaccgacaggcagaattcttcgagggtgtaggcgccgttggccagcgggtacagctcgtccatcagggcgatggagcggtccagcacatcggcgtccgcgcggtgcaggccgattacgccggagttcagcagcggcatctgctcgtcggcgagttttcgttcccgcagcaagccggccagggactggtagaggccggactccttgttggcgccgtagcacatgccgaatgcgttacacagcagggtgccgggctggatgcggcgaaacagctccagcggcgagcagtggaaaaaggtatcggtgtcgatcagcaacgccagttcggactcttgcagcacctgctgcatcaccacgtgcttggcgcgaaagt
